United States Patent 9,926,593 (PROCESSES AND KITS FOR IDENTIFYING ANEUPLOIDY) - sequence listing, part 2

SEQ ID NO: 4773 - DNA, 460 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (37)..(37): a, c, t, g, unknown or other
  modified_base (57)..(57): a, c, t, g, unknown or other
  modified_base (69)..(69): a, c, t, g, unknown or other
  modified_base (72)..(72): a, c, t, g, unknown or other
  modified_base (113)..(113): a, c, t, g, unknown or other
  modified_base (146)..(146): a, c, t, g, unknown or other
  modified_base (157)..(157): a, c, t, g, unknown or other
  modified_base (167)..(167): a, c, t, g, unknown or other
  modified_base (174)..(174): a, c, t, g, unknown or other
  modified_base (191)..(191): a, c, t, g, unknown or other
  modified_base (201)..(201): a, c, t, g, unknown or other
  modified_base (212)..(212): a, c, t, g, unknown or other
  modified_base (225)..(225): a, c, t, g, unknown or other
  modified_base (231)..(231): a, c, t, g, unknown or other
  modified_base (243)..(243): a, c, t, g, unknown or other
  modified_base (284)..(284): a, c, t, g, unknown or other
  modified_base (297)..(297): a, c, t, g, unknown or other
  modified_base (300)..(300): a, c, t, g, unknown or other
  modified_base (302)..(302): a, c, t, g, unknown or other
  modified_base (305)..(305): a, c, t, g, unknown or other
  modified_base (308)..(308): a, c, t, g, unknown or other
  modified_base (313)..(313): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (342)..(342): a, c, t, g, unknown or other
  modified_base (347)..(347): a, c, t, g, unknown or other
  modified_base (371)..(371): a, c, t, g, unknown or other
  modified_base (408)..(408): a, c, t, g, unknown or other
  modified_base (414)..(414): a, c, t, g, unknown or other
  modified_base (420)..(420): a, c, t, g, unknown or other
  modified_base (422)..(422): a, c, t, g, unknown or other
  modified_base (443)..(443): a, c, t, g, unknown or other
  modified_base (453)..(453): a, c, t, g, unknown or other
tccttcactttgaagrtgtcagctnccagnacataangacaaagagaaaacctcagngtcatgtttaancantctgatttatactgaggacaaattaaagaaagtaatttatntaaygaagagtaaacttatggaactcattgccnaaagaggaggnacagacrtanaaatatncaaagacatctacgagnaattgttcanacmtttattgnacagcagcctaanagaacntggagcacgatnaygtttggagtcaccctgaggttsacatcacagcacacaanagctttttgcccnacngncantgngcccnagtgntttctgaggacnggaatngggagntgganggacctgcaggtcctccccatggnacaaacgctgcaccttgcacacacctgggtccctgcnatgtcnagcccnancctgtgcacagtgaggagagnacacctggtnatcagga

SEQ ID NO: 4774 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattakgcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4775 - DNA, 517 bp, Artificial Sequence
  Description of Artificial Sequence: Synthetic polynucleotide
  modified_base (83)..(83): a, c, t, g, unknown or other
  modified_base (133)..(133): a, c, t, g, unknown or other
  modified_base (226)..(226): a, c, t, g, unknown or other
  modified_base (315)..(315): a, c, t, g, unknown or other
  modified_base (344)..(344): a, c, t, g, unknown or other
  modified_base (404)..(404): a, c, t, g, unknown or other
  modified_base (408)..(408): a, c, t, g, unknown or other
  modified_base (414)..(414): a, c, t, g, unknown or other
  modified_base (426)..(426): a, c, t, g, unknown or other
  modified_base (461)..(461): a, c, t, g, unknown or other
  modified_base (483)..(483): a, c, t, g, unknown or other
  modified_base (490)..(490): a, c, t, g, unknown or other
tttttccaccaccccaatgctacctctataactcacacatgatagttttataaagataactacctggcattcaggttaaaatncaacwgcacccagaatagraaaaactataaattatgcattggactctgcnatcaccagcccctacttgtaaatttcaatggagattcactttayttcaaaattagaaaactgatctcagagtttaaaacctcatttacagctncaaaatatttagaatctagaattatataacaaatacttaytttcttagcatgcaaaaattatttacaaatcatttaaaaaggatgatcnacttaacagaaaaatgggcaatgacaaanagactattagttacctaaccaatagccactccccactcacaacctgttccttacagagtncacntcccantatcatggctgnaaggaacatcyttgctctctcaccctcacttgtanctaggacatggatggataccantcacggntgatgggatttaagaaaaaaatctgtt

SEQ ID NO: 4776 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  modified_base (369)..(369): a, c, t, g, unknown or other
  modified_base (406)..(406): a, c, t, g, unknown or other
  modified_base (448)..(448): a, c, t, g, unknown or other
  modified_base (510)..(510): a, c, t, g, unknown or other
  modified_base (530)..(530): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacntatctgtgggaaaagcatttttagtagaatgcttgcncatcttcctacattcctgtaatcaaacagtatttatcatcanctatgttggtgactctcactttgacataggctgaaccagaaatcctaggaaaaactgatganagaaagctaaggggaagganaggaagccgggaaaccctgggaaaggagggattatattacacatgttaygggaactagtttgtatntgcggggcacagagcatacacttagataagaagggggtcataaaaccagaaaggcaataaatagaat

SEQ ID NO: 4777 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttytggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4778 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatrtgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4779 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (126)..(126): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  misc_feature (549)..(549): May or may not be present
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcngtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttaccaaaaaaacctcatttttaggccaaaataanttacaacttgctgaaanaccttttatggctcagtgctcattc

SEQ ID NO: 4780 - DNA, 1143 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  misc_feature (194)..(196): This region may encompass 'cca' or is absent in its entirety
  modified_base (213)..(213): a, c, t, g, unknown or other
  modified_base (233)..(233): a, c, t, g, unknown or other
  modified_base (256)..(256): a, c, t, g, unknown or other
  modified_base (289)..(289): a, c, t, g, unknown or other
  modified_base (296)..(296): a, c, t, g, unknown or other
  modified_base (303)..(303): a, c, t, g, unknown or other
  modified_base (305)..(305): a, c, t, g, unknown or other
  modified_base (314)..(314): a, c, t, g, unknown or other
  modified_base (318)..(318): a, c, t, g, unknown or other
  modified_base (333)..(333): a, c, t, g, unknown or other
  modified_base (358)..(358): a, c, t, g, unknown or other
  modified_base (375)..(375): a, c, t, g, unknown or other
  modified_base (383)..(383): a, c, t, g, unknown or other
  modified_base (393)..(393): a, c, t, g, unknown or other
  modified_base (396)..(396): a, c, t, g, unknown or other
  modified_base (410)..(410): a, c, t, g, unknown or other
  modified_base (413)..(413): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (445)..(445): a, c, t, g, unknown or other
  modified_base (460)..(460): a, c, t, g, unknown or other
  modified_base (478)..(478): a, c, t, g, unknown or other
  modified_base (490)..(490): a, c, t, g, unknown or other
  modified_base (500)..(500): a, c, t, g, unknown or other
  modified_base (514)..(514): a, c, t, g, unknown or other
  modified_base (527)..(527): a, c, t, g, unknown or other
  modified_base (536)..(536): a, c, t, g, unknown or other
  modified_base (538)..(538): a, c, t, g, unknown or other
  modified_base (571)..(571): a, c, t, g, unknown or other
  modified_base (638)..(638): a, c, t, g, unknown or other
  modified_base (642)..(642): a, c, t, g, unknown or other
  modified_base (656)..(656): a, c, t, g, unknown or other
  modified_base (658)..(658): a, c, t, g, unknown or other
  modified_base (669)..(669): a, c, t, g, unknown or other
  modified_base (671)..(671): a, c, t, g, unknown or other
  modified_base (678)..(678): a, c, t, g, unknown or other
  modified_base (721)..(758): a, c, t, g, unknown or other
  modified_base (760)..(824): a, c, t, g, unknown or other
  modified_base (846)..(846): a, c, t, g, unknown or other
  modified_base (867)..(867): a, c, t, g, unknown or other
  modified_base (875)..(875): a, c, t, g, unknown or other
  modified_base (885)..(885): a, c, t, g, unknown or other
  modified_base (889)..(889): a, c, t, g, unknown or other
  modified_base (894)..(894): a, c, t, g, unknown or other
  modified_base (896)..(896): a, c, t, g, unknown or other
  modified_base (925)..(925): a, c, t, g, unknown or other
  modified_base (934)..(934): a, c, t, g, unknown or other
  modified_base (940)..(940): a, c, t, g, unknown or other
  modified_base (942)..(942): a, c, t, g, unknown or other
  modified_base (956)..(956): a, c, t, g, unknown or other
  modified_base (975)..(975): a, c, t, g, unknown or other
  modified_base (980)..(980): a, c, t, g, unknown or other
  modified_base (988)..(988): a, c, t, g, unknown or other
  modified_base (1002)..(1002): a, c, t, g, unknown or other
  modified_base (1012)..(1096): a, c, t, g, unknown or other
  modified_base (1098)..(1116): a, c, t, g, unknown or other
  modified_base (1137)..(1137): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttaccatattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcntccactaaccagaagcatgtcccagctctcttctgtgtcccaccattagaaaatcaaaagctgactntagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaanatacaccnttgatcatantgtntctcnancaaaagcttcaatggtcaagtactgaacnttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 4781 - DNA, 125 bp, Artificial Sequence
  Description of Artificial Sequence: Synthetic polynucleotide
  modified_base (10)..(10): a, c, t, g, unknown or other
  modified_base (52)..(52): a, c, t, g, unknown or other
  modified_base (71)..(71): a, c, t, g, unknown or other
  modified_base (94)..(94): a, c, t, g, unknown or other
  modified_base (116)..(116): a, c, t, g, unknown or other
aagcaccagnagaggaaagggaaaaaaacctgcagcatasacaagctttganttgtgtgatctgtgaaaantgtatagaaatgttaccttaccnaaaaattcccaaggtgctttanttgccmacc

SEQ ID NO: 4782 - DNA, 118 bp, Artificial Sequence
  Description of Artificial Sequence: Synthetic polynucleotide
  modified_base (3)..(3): a, c, t, g, unknown or other
  modified_base (31)..(31): a, c, t, g, unknown or other
  misc_feature (39)..(40): This region may encompass 'cc' or 'gg'
canggggaagatcttaaagggagcttttaanatacaaasstaaaataagagtaatttattggctataaatttaaatatgggaagattatcatcaggaaacaaattctaggcttacaaa

SEQ ID NO: 4783 - DNA, 297 bp, Artificial Sequence
  Description of Artificial Sequence: Synthetic polynucleotide
  modified_base (7)..(7): a, c, t, g, unknown or other
  modified_base (15)..(15): a, c, t, g, unknown or other
  modified_base (24)..(24): a, c, t, g, unknown or other
  modified_base (26)..(26): a, c, t, g, unknown or other
  modified_base (50)..(50): a, c, t, g, unknown or other
  modified_base (55)..(55): a, c, t, g, unknown or other
  modified_base (57)..(57): a, c, t, g, unknown or other
  modified_base (62)..(62): a, c, t, g, unknown or other
  modified_base (85)..(85): a, c, t, g, unknown or other
  modified_base (91)..(91): a, c, t, g, unknown or other
  modified_base (93)..(93): a, c, t, g, unknown or other
  modified_base (95)..(95): a, c, t, g, unknown or other
  modified_base (98)..(98): a, c, t, g, unknown or other
  modified_base (111)..(111): a, c, t, g, unknown or other
  modified_base (157)..(157): a, c, t, g, unknown or other
  modified_base (163)..(163): a, c, t, g, unknown or other
  modified_base (168)..(168): a, c, t, g, unknown or other
  modified_base (182)..(182): a, c, t, g, unknown or other
  modified_base (188)..(188): a, c, t, g, unknown or other
  modified_base (200)..(200): a, c, t, g, unknown or other
  modified_base (204)..(204): a, c, t, g, unknown or other
  modified_base (212)..(212): a, c, t, g, unknown or other
  modified_base (221)..(221): a, c, t, g, unknown or other
  modified_base (239)..(239): a, c, t, g, unknown or other
  modified_base (244)..(244): a, c, t, g, unknown or other
  modified_base (247)..(247): a, c, t, g, unknown or other
  modified_base (265)..(265): a, c, t, g, unknown or other
  modified_base (281)..(281): a, c, t, g, unknown or other
ctccccnaggcccanacaccacgntngtrcacagaatcttaccacdatcnctccnkncttgngcgcacttggcagagtggagcangggacntncnctngacagacaaggcngcatctcttatmgagtgggaggggcctgcctcactcatccgcctcnccccanccaangacctcttcaggangcactngcaaacacygtngtgngtygtagnagagggcantggggttggcacaacccnccacngtnttgtctcgggcacgtggngcaatctggagcactnctggatcaccacaaag

SEQ ID NO: 4784 - DNA, 119 bp, Artificial Sequence
  Description of Artificial Sequence: Synthetic polynucleotide
  modified_base (2)..(2): a, c, t, g, unknown or other
  modified_base (42)..(42): a, c, t, g, unknown or other
  modified_base (48)..(48): a, c, t, g, unknown or other
  modified_base (51)..(51): a, c, t, g, unknown or other
  modified_base (55)..(55): a, c, t, g, unknown or other
  modified_base (64)..(64): a, c, t, g, unknown or other
  modified_base (73)..(73): a, c, t, g, unknown or other
  modified_base (81)..(81): a, c, t, g, unknown or other
  modified_base (111)..(111): a, c, t, g, unknown or other
angattgcaatagaattggccaacatctcaacagagttacangattgncanattntctgaattncctcaayanagagccantawtctgagtctgggaatgctaaatgaaanccatgcct

SEQ ID NO: 4785 - DNA, 665 bp, Artificial Sequence
  Description of Artificial Sequence: Synthetic polynucleotide
  modified_base (39)..(39): a, c, t, g, unknown or other
  modified_base (45)..(45): a, c, t, g, unknown or other
  modified_base (48)..(48): a, c, t, g, unknown or other
  modified_base (62)..(62): a, c, t, g, unknown or other
  modified_base (70)..(70): a, c, t, g, unknown or other
  modified_base (84)..(84): a, c, t, g, unknown or other
  modified_base (89)..(89): a, c, t, g, unknown or other
  modified_base (108)..(108): a, c, t, g, unknown or other
  modified_base (113)..(113): a, c, t, g, unknown or other
  modified_base (130)..(130): a, c, t, g, unknown or other
  modified_base (140)..(140): a, c, t, g, unknown or other
  modified_base (162)..(162): a, c, t, g, unknown or other
  modified_base (165)..(165): a, c, t, g, unknown or other
  modified_base (169)..(169): a, c, t, g, unknown or other
  modified_base (193)..(193): a, c, t, g, unknown or other
  modified_base (197)..(197): a, c, t, g, unknown or other
  modified_base (224)..(224): a, c, t, g, unknown or other
  modified_base (226)..(226): a, c, t, g, unknown or other
  modified_base (230)..(230): a, c, t, g, unknown or other
  modified_base (235)..(235): a, c, t, g, unknown or other
  modified_base (245)..(245): a, c, t, g, unknown or other
  modified_base (250)..(250): a, c, t, g, unknown or other
  modified_base (252)..(252): a, c, t, g, unknown or other
  modified_base (266)..(266): a, c, t, g, unknown or other
  modified_base (278)..(278): a, c, t, g, unknown or other
  modified_base (291)..(291): a, c, t, g, unknown or other
  modified_base (305)..(305): a, c, t, g, unknown or other
  modified_base (322)..(322): a, c, t, g, unknown or other
  modified_base (352)..(352): a, c, t, g, unknown or other
  modified_base (363)..(363): a, c, t, g, unknown or other
  modified_base (367)..(367): a, c, t, g, unknown or other
  modified_base (395)..(395): a, c, t, g, unknown or other
  modified_base (429)..(429): a, c, t, g, unknown or other
  modified_base (444)..(444): a, c, t, g, unknown or other
  modified_base (460)..(460): a, c, t, g, unknown or other
  modified_base (477)..(477): a, c, t, g, unknown or other
  modified_base (486)..(486): a, c, t, g, unknown or other
  modified_base (488)..(488): a, c, t, g, unknown or other
  modified_base (493)..(493): a, c, t, g, unknown or other
  modified_base (510)..(510): a, c, t, g, unknown or other
  modified_base (515)..(515): a, c, t, g, unknown or other
  modified_base (517)..(517): a, c, t, g, unknown or other
  modified_base (519)..(519): a, c, t, g, unknown or other
  modified_base (539)..(539): a, c, t, g, unknown or other
  modified_base (559)..(559): a, c, t, g, unknown or other
  modified_base (561)..(561): a, c, t, g, unknown or other
  modified_base (597)..(597): a, c, t, g, unknown or other
  modified_base (607)..(607): a, c, t, g, unknown or other
  modified_base (609)..(609): a, c, t, g, unknown or other
  modified_base (615)..(615): a, c, t, g, unknown or other
  modified_base (621)..(621): a, c, t, g, unknown or other
  modified_base (642)..(642): a, c, t, g, unknown or other
  modified_base (644)..(644): a, c, t, g, unknown or other
caggcagcacctcacrgaatccaggctcacagaaagtcngtttcnatnagaatttaaaacanccctcttntgctgcaactcttnaggcnactgacaaggtgacaggancacantttgtacaggatacaancatattcccnatgggtggacaaaacgaccccntancccntctacaccaaggagctgcacctgngccntgtgtagccagatgcaattttctattntngganaatcnactttaagtngttcntnagcaaattcttccnaagtactgtttnctttcctcaattnctggcctagcaagntagaaagaaaacaaaangaatgtaaaatgttcttggttgactttacncttaattactnaaangcaaacagagaaaattaaaatcaaacantgcaaaaaattcttctagagccttgcacacaatnccagttcttgaaatnttcataaagcaaagcnaatgaaataaacaaagncrtggctgnanggatntgcattgtactrtgctnatggncnanttgctcactgcatctctcgntccacygccrccrggctcrncnccagaagcctgttcctgagctgattggggttctggnccaggggtcncnaggagngaggcncaagctcaggaggacaaarancnaccacctggaaagtggcaaaa

SEQ ID NO: 4786 - DNA, 1622 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  misc_feature (732)..(733): This region may encompass 'ca' or 'ag'
  modified_base (766)..(766): a, c, t, g, unknown or other
  modified_base (802)..(802): a, c, t, g, unknown or other
  modified_base (818)..(818): a, c, t, g, unknown or other
  modified_base (827)..(827): a, c, t, g, unknown or other
  modified_base (859)..(859): a, c, t, g, unknown or other
  modified_base (886)..(886): a, c, t, g, unknown or other
  modified_base (907)..(907): a, c, t, g, unknown or other
  modified_base (920)..(920): a, c, t, g, unknown or other
  modified_base (964)..(964): a, c, t, g, unknown or other
  modified_base (984)..(984): a, c, t, g, unknown or other
  modified_base (990)..(990): a, c, t, g, unknown or other
  modified_base (1029)..(1029): a, c, t, g, unknown or other
  modified_base (1039)..(1039): a, c, t, g, unknown or other
  modified_base (1106)..(1106): a, c, t, g, unknown or other
  modified_base (1108)..(1108): a, c, t, g, unknown or other
  modified_base (1124)..(1124): a, c, t, g, unknown or other
  modified_base (1152)..(1152): a, c, t, g, unknown or other
  modified_base (1157)..(1157): a, c, t, g, unknown or other
  modified_base (1159)..(1159): a, c, t, g, unknown or other
  modified_base (1167)..(1167): a, c, t, g, unknown or other
  modified_base (1208)..(1208): a, c, t, g, unknown or other
  modified_base (1222)..(1222): a, c, t, g, unknown or other
  modified_base (1236)..(1236): a, c, t, g, unknown or other
  modified_base (1240)..(1240): a, c, t, g, unknown or other
  modified_base (1272)..(1272): a, c, t, g, unknown or other
  modified_base (1275)..(1275): a, c, t, g, unknown or other
  modified_base (1301)..(1301): a, c, t, g, unknown or other
  modified_base (1325)..(1325): a, c, t, g, unknown or other
  modified_base (1338)..(1338): a, c, t, g, unknown or other
  modified_base (1367)..(1367): a, c, t, g, unknown or other
  modified_base (1389)..(1389): a, c, t, g, unknown or other
  modified_base (1394)..(1394): a, c, t, g, unknown or other
  modified_base (1400)..(1400): a, c, t, g, unknown or other
  modified_base (1439)..(1439): a, c, t, g, unknown or other
  modified_base (1442)..(1442): a, c, t, g, unknown or other
  modified_base (1515)..(1515): a, c, t, g, unknown or other
  modified_base (1525)..(1525): a, c, t, g, unknown or other
  modified_base (1534)..(1534): a, c, t, g, unknown or other
  modified_base (1568)..(1568): a, c, t, g, unknown or other
  modified_base (1587)..(1587): a, c, t, g, unknown or other
  modified_base (1593)..(1593): a, c, t, g, unknown or other
  modified_base (1619)..(1619): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcmrttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4787 - DNA, 170 bp, Artificial Sequence
  Description of Artificial Sequence: Synthetic polynucleotide
  modified_base (26)..(26): a, c, t, g, unknown or other
  modified_base (32)..(32): a, c, t, g, unknown or other
  modified_base (41)..(41): a, c, t, g, unknown or other
  modified_base (70)..(70): a, c, t, g, unknown or other
  modified_base (77)..(77): a, c, t, g, unknown or other
  modified_base (85)..(85): a, c, t, g, unknown or other
  modified_base (90)..(90): a, c, t, g, unknown or other
  modified_base (144)..(144): a, c, t, g, unknown or other
  modified_base (156)..(156): a, c, t, g, unknown or other
  modified_base (158)..(158): a, c, t, g, unknown or other
cactattattcatctcatagagtaanacagcntctggtctnaacagccaaaagcctatcatcacawaaanaaatganttaattgnctggntctctaaataaagggaataaatcaccctagacaacaaggtcttggagggcctcntctgggtggtcncnaccacatgcccc

SEQ ID NO: 4788 - DNA, 151 bp, Artificial Sequence
  Description of Artificial Sequence: Synthetic polynucleotide
  modified_base (50)..(50): a, c, t, g, unknown or other
  misc_feature (74)..(74): May or may not be present
  modified_base (90)..(90): a, c, t, g, unknown or other
cttcctgttttcatttgtaattggaatwttatcaccattttcctttagancatacatcattgggttaccaaaaagatctgtctgtgatanctggaaagtgatcatcatgtcatcttccacattcccttcatactccaataaatcttttaaa

SEQ ID NO: 4789 - DNA, 325 bp, Artificial Sequence
  Description of Artificial Sequence: Synthetic polynucleotide
  modified_base (52)..(52): a, c, t, g, unknown or other
  modified_base (73)..(73): a, c, t, g, unknown or other
  modified_base (182)..(182): a, c, t, g, unknown or other
  modified_base (252)..(252): a, c, t, g, unknown or other
gagcagcatttcaaggccctccatgctttggtctctgccaaatcactattanatttttaagatttttttttanacattatacttacattacacaatgtcttaacactatgaagtaaaaatgtaaatattttaaactctggcttggaaatgaggaggcagaatctcagawattttcctaaaanaaataggagaggcaagctttctgagtccacaaaagtgccctctacctattgggtcaaagaaaaagtaatntctctatttgtaacaacatacataaattataaaccctgaagaaataggtccctaatagctataatctttaaca

SEQ ID NO: 4790 - DNA, 619 bp, Artificial Sequence
  Description of Artificial Sequence: Synthetic polynucleotide
  modified_base (201)..(201): a, c, t, g, unknown or other
  modified_base (204)..(204): a, c, t, g, unknown or other
  modified_base (222)..(222): a, c, t, g, unknown or other
  modified_base (259)..(259): a, c, t, g, unknown or other
  modified_base (389)..(389): a, c, t, g, unknown or other
  modified_base (423)..(423): a, c, t, g, unknown or other
  modified_base (551)..(551): a, c, t, g, unknown or other
atagagtgattttgaagattaagcaggctagtgggtcaagcacgtagtacaacatttgaagcccaaaggcagggagtgtgagccccaggtggtggtggsggggatgaaaggagaagcagraggcaatggggaasgagrcacttgaractggaactcagggctcttcagagagagaagcttycaggtcctggagaaggggynagncccatgcgagtcccctgnaygctcaaaaggaagggccaggtttccctgacacagngggctcygtggtctcctcccctcctwttcacctcrggagggagggaaagaggggaagagaaggtcctgcagaggaggyaggatggccggttgaggggggccttgggcgctttttcccaagggctgcctcntgyggcwgccccaggggcttccttgaacaagaantccctgctctcccgctgagagccagggtgggtcctctrtccctcaccatgaagttcaatgagtattggagagtccgcatgaggygaaggggcttcagcccaaccrctggtccctgctgcactcactcntcaaraaggaccaccagctgcctgatggtgagcatggagcaggtctgagtggaccagactagggccaa

SEQ ID NO: 4791 - DNA, 621 bp, Artificial Sequence
  Description of Artificial Sequence: Synthetic polynucleotide
  modified_base (37)..(37): a, c, t, g, unknown or other
  modified_base (44)..(44): a, c, t, g, unknown or other
  modified_base (56)..(56): a, c, t, g, unknown or other
  modified_base (66)..(66): a, c, t, g, unknown or other
  modified_base (72)..(72): a, c, t, g, unknown or other
  modified_base (77)..(77): a, c, t, g, unknown or other
  modified_base (79)..(79): a, c, t, g, unknown or other
  modified_base (107)..(107): a, c, t, g, unknown or other
  modified_base (110)..(110): a, c, t, g, unknown or other
  modified_base (121)..(121): a, c, t, g, unknown or other
  modified_base (148)..(148): a, c, t, g, unknown or other
  modified_base (190)..(190): a, c, t, g, unknown or other
  modified_base (219)..(219): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (279)..(279): a, c, t, g, unknown or other
  modified_base (288)..(288): a, c, t, g, unknown or other
  modified_base (292)..(292): a, c, t, g, unknown or other
  modified_base (323)..(323): a, c, t, g, unknown or other
  modified_base (336)..(336): a, c, t, g, unknown or other
  modified_base (344)..(344): a, c, t, g, unknown or other
  modified_base (352)..(352): a, c, t, g, unknown or other
  modified_base (392)..(392): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (453)..(453): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (506)..(506): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
  modified_base (579)..(579): a, c, t, g, unknown or other
  modified_base (596)..(596): a, c, t, g, unknown or other
atacagtactgcaaactcagtaaaaggagtttttgantrgagtntgaactttcaanttgaagatanatttcncaggnanattcacccaaagcttgagagctagagcnagnagagacttgcnaktcrgtaactgagtagatgaaatgcntaatttttcactaggtgataattccctttgggaagaagtgcnttatctttaattattccactttttgttanatggttcatgcttttnaactgcnttgtctnaaacttgcttgctattgaattgtgtaacancagataatngcangttgtcaaaagataaccccagtggatawttnaagctgcttttangagaagcntggtgctnagctgccttacacagtctttttacagtaaccataaaaaanctgagtttatttgatcatgtattatcccttntcanataangtcatattagaggaattcttnrnaagangntttcaaactagtcctttgggcatttaaaaaatmattatataaangtacacttcttcaatacataagaacaaanatttttnctttacnaaaaaaacctcatttttaggccaaaataanttacaacttgctgaaanaccttttatggctcagtgctcattc

SEQ ID NO: 4792 - DNA, 1149 bp, Artificial Sequence
  Description of Artificial Sequence: Synthetic polynucleotide
  modified_base (70)..(70): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaawgataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4793 - DNA, 1107 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  misc_feature (644)..(647): This region may encompass 'caag' or is absent in its entirety
  modified_base (649)..(649): a, c, t, g, unknown or other
  modified_base (667)..(667): a, c, t, g, unknown or other
  modified_base (670)..(670): a, c, t, g, unknown or other
  modified_base (713)..(713): a, c, t, g, unknown or other
  modified_base (720)..(720): a, c, t, g, unknown or other
  modified_base (800)..(800): a, c, t, g, unknown or other
  modified_base (811)..(811): a, c, t, g, unknown or other
  modified_base (816)..(816): a, c, t, g, unknown or other
  modified_base (824)..(824): a, c, t, g, unknown or other
  modified_base (843)..(843): a, c, t, g, unknown or other
  modified_base (904)..(904): a, c, t, g, unknown or other
  modified_base (967)..(967): a, c, t, g, unknown or other
  modified_base (990)..(990): a, c, t, g, unknown or other
  modified_base (1019)..(1019): a, c, t, g, unknown or other
  modified_base (1059)..(1059): a, c, t, g, unknown or other
  modified_base (1097)..(1097): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagcaaganctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagnatatttcatgtgtattacagtggtattcatatgctatgtntctaaactttattttcaaaagcttaaggcccaaatacnaacttctctg

SEQ ID NO: 4794 - DNA, 3427 bp, Artificial Sequence
  Description of Artificial Sequence: Synthetic polynucleotide
  modified_base (13)..(13): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttaytggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4795 - DNA, 661 bp, Artificial Sequence
  Description of Artificial Sequence: Synthetic polynucleotide
  modified_base (14)..(14): a, c, t, g, unknown or other
  modified_base (213)..(213): a, c, t, g, unknown or other
  modified_base (240)..(240): a, c, t, g, unknown or other
  modified_base (489)..(489): a, c, t, g, unknown or other
  modified_base (649)..(649): a, c, t, g, unknown or other
tacagtaaaatatnaaatctctttttctcctatccttctgctggtacttcaatttctgctggtactgttccatcattgccctctaaataataatggcttcataaaatgaaaataaacaacatacaataaaccagtaaaaattcacattgaaagagaaaagagaagctaggtaacaatgcaaacacttttaagacataataaacatataaaaantgatccttttaactcaatccaaayaangtttctaattcagaaaaaaatataacacatatttggaagctggaaaacattattttaaaatatgaatacacagtagactcaagtaggtttagggatttaatattagtgtatctatgtgataaaattactggatattggaatctgaagaagtacaattatggttcaagtaccatgctcatctgtcactgacacacacacacaaacaaattagcatgaatgcttgctttgctcagacaattaactctctanaagttcagggtttgctgtggaatgctccctgttttccattttcactatggtgaaagctatggaaactcaatccatgtaatttaatccaagctgtacataaagtaacttataagtaaaaactgaagatactacctttagtgtcaaaaatattttaatcccngtaatataatct

SEQ ID NO: 4796 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcarattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4797 - DNA, 171 bp, Artificial Sequence
  Description of Artificial Sequence: Synthetic polynucleotide
  modified_base (8)..(8): a, c, t, g, unknown or other
  modified_base (17)..(17): a, c, t, g, unknown or other
  modified_base (26)..(26): a, c, t, g, unknown or other
  modified_base (50)..(50): a, c, t, g, unknown or other
  modified_base (90)..(90): a, c, t, g, unknown or other
  modified_base (155)..(155): a, c, t, g, unknown or other
  modified_base (159)..(159): a, c, t, g, unknown or other
  modified_base (169)..(169): a, c, t, g, unknown or other
cttcccanctctttggntttctttcngtrctgttttgcagttgttttcangatacattatgtacctatttctaaaactattgataggagnttccagagatcagggagttgtaggtattaatacattkcccacctctcttggtgcccagttcaggnctyntctcatgggngc

SEQ ID NO: 4798 - DNA, 322 bp, Artificial Sequence
  Description of Artificial Sequence: Synthetic polynucleotide
  modified_base (64)..(64): a, c, t, g, unknown or other
  modified_base (66)..(66): a, c, t, g, unknown or other
  modified_base (86)..(86): a, c, t, g, unknown or other
  modified_base (115)..(115): a, c, t, g, unknown or other
  modified_base (129)..(129): a, c, t, g, unknown or other
  modified_base (145)..(145): a, c, t, g, unknown or other
  modified_base (147)..(147): a, c, t, g, unknown or other
  modified_base (155)..(155): a, c, t, g, unknown or other
  modified_base (179)..(179): a, c, t, g, unknown or other
  modified_base (217)..(217): a, c, t, g, unknown or other
  modified_base (241)..(241): a, c, t, g, unknown or other
  modified_base (265)..(265): a, c, t, g, unknown or other
  modified_base (270)..(270): a, c, t, g, unknown or other
  modified_base (282)..(282): a, c, t, g, unknown or other
tgactggcctctcttttacctatctggttttgaattacattggctaacttcagaaaartcatcntnactaaattgtctctgaaagntaattgaggcagaagatatatgcagtycntcagcaattgtttnagctgcactgtcagtntngaaataancagcctaataagaggtcagatacntggrktttaaaagcctatttatcatacagtattcaaancctttaatcattttataagcctcncmttaaatgtcagttgtcattctntttcncatcatgattanttaacaaaccaaaataccattatgttgttccttttctaga

SEQ ID NO: 4799 - DNA, 828 bp, Artificial Sequence
  Description of Artificial Sequence: Synthetic polynucleotide
  modified_base (4)..(4): a, c, t, g, unknown or other
  modified_base (13)..(13): a, c, t, g, unknown or other
  modified_base (18)..(18): a, c, t, g, unknown or other
  modified_base (21)..(21): a, c, t, g, unknown or other
  modified_base (53)..(53): a, c, t, g, unknown or other
  modified_base (67)..(67): a, c, t, g, unknown or other
  modified_base (69)..(69): a, c, t, g, unknown or other
  modified_base (86)..(86): a, c, t, g, unknown or other
  modified_base (95)..(95): a, c, t, g, unknown or other
  modified_base (117)..(117): a, c, t, g, unknown or other
  modified_base (120)..(120): a, c, t, g, unknown or other
  modified_base (130)..(130): a, c, t, g, unknown or other
  modified_base (144)..(144): a, c, t, g, unknown or other
  modified_base (184)..(184): a, c, t, g, unknown or other
  modified_base (207)..(207): a, c, t, g, unknown or other
  modified_base (211)..(211): a, c, t, g, unknown or other
  modified_base (223)..(223): a, c, t, g, unknown or other
  modified_base (228)..(228): a, c, t, g, unknown or other
  modified_base (231)..(231): a, c, t, g, unknown or other
  modified_base (257)..(257): a, c, t, g, unknown or other
  modified_base (279)..(279): a, c, t, g, unknown or other
  modified_base (284)..(284): a, c, t, g, unknown or other
  modified_base (292)..(292): a, c, t, g, unknown or other
  modified_base (313)..(313): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (338)..(338): a, c, t, g, unknown or other
  modified_base (372)..(493): a, c, t, g, unknown or other
  modified_base (499)..(499): a, c, t, g, unknown or other
  modified_base (521)..(521): a, c, t, g, unknown or other
  modified_base (549)..(549): a, c, t, g, unknown or other
  modified_base (557)..(557): a, c, t, g, unknown or other
  modified_base (565)..(565): a, c, t, g, unknown or other
  modified_base (569)..(591): a, c, t, g, unknown or other
  modified_base (593)..(593): a, c, t, g, unknown or other
  modified_base (610)..(610): a, c, t, g, unknown or other
  modified_base (650)..(650): a, c, t, g, unknown or other
  modified_base (686)..(686): a, c, t, g, unknown or other
  modified_base (746)..(746): a, c, t, g, unknown or other
  modified_base (764)..(764): a, c, t, g, unknown or other
  modified_base (786)..(786): a, c, t, g, unknown or other
  modified_base (788)..(788): a, c, t, g, unknown or other
  modified_base (803)..(803): a, c, t, g, unknown or other
  modified_base (805)..(805): a, c, t, g, unknown or other
  modified_base (821)..(821): a, c, t, g, unknown or other
tatncatgtgtantgcanacnttctttcttcctttctcatccttgcagtcgcnttctcttccttttncntctttcattccrtttangtgtcaaanaccacargtctgggaaaggaanaanatgtaagagnaagatgcctactangtgggcacatagagagctcctggtgggacagggactgcanagaagagccactgcttggagagntttntcaaaaactctnccttnatntaaatgaatttcaacagcaaagtgangacatatccacacatttaaatnaaatncttccccntttccctggcakttaatatangaaatantntancatgtttatcaanggaaaacaccaccaaagacctgctttttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatngtcataattggtcctgtctaanatgagagccatggggaatgcccaattanattggytngtttcctnccannnnnnnnnnnnnnnnnnnnnnntntcctgatgaggtggttntccagatacttgtatctggtatccagattttctctgcttntccacagcaagaaatgatgtagggcatctctaggcngtcttttgcccctaatccagactcatgggtctcrgggattaagggtcctccaccaattcntaagaccttcacctattntccttgttaccatcatcacaananttctgtttctgattncncctgctcctctcccanattttta

SEQ ID NO: 4800 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  misc_feature (1260)..(1260): May or may not be present
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2800)..(2800): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtcttttgccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacnaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4801 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (241)..(241): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (737)..(737): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagnacgttggccacaggctgacccgtgcagggggcaagggcttaagacggccccatcttccactccaagtgtggtctcaatcttgttggccagtttatgaaagtcaagcctaytgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagngtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4802 - DNA, 354 bp, Artificial Sequence
  Description of Artificial Sequence: Synthetic polynucleotide
  modified_base (43)..(43): a, c, t, g, unknown or other
  modified_base (49)..(49): a, c, t, g, unknown or other
  modified_base (57)..(57): a, c, t, g, unknown or other
  modified_base (63)..(63): a, c, t, g, unknown or other
  modified_base (119)..(119): a, c, t, g, unknown or other
  modified_base (126)..(126): a, c, t, g, unknown or other
  modified_base (128)..(128): a, c, t, g, unknown or other
  modified_base (158)..(158): a, c, t, g, unknown or other
  modified_base (166)..(166): a, c, t, g, unknown or other
  modified_base (176)..(176): a, c, t, g, unknown or other
  modified_base (207)..(207): a, c, t, g, unknown or other
  modified_base (211)..(211): a, c, t, g, unknown or other
  modified_base (213)..(213): a, c, t, g, unknown or other
  modified_base (236)..(351): a, c, t, g, unknown or other
ccctctcaaatcattctagtctggtttaccaaacagaaccacnagctangaggatanaaatanttcccrtgttcactagccattaaatraacatagccacttgtgcaggaagcctaacntttttananttcctaactttttaaaacttaaggataagnccatttcnacaagctaantttacagctccttaatattcttmatctggangttnantttgcagactttgttggtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnata

SEQ ID NO: 4803 - DNA, 129 bp, Artificial Sequence
  Description of Artificial Sequence: Synthetic polynucleotide
  modified_base (43)..(43): a, c, t, g, unknown or other
  modified_base (47)..(47): a, c, t, g, unknown or other
  modified_base (63)..(63): a, c, t, g, unknown or other
ataaataatttgtagttgtgttataatagacactattttccanggtnggcaatggtaaacaanccctttaaggggaaatgattagaaatagaaacttcragcaccctgccatagtgaaatgtggccctc

SEQ ID NO: 4804 - DNA, 921 bp, Artificial Sequence
  Description of Artificial Sequence: Synthetic polynucleotide
  modified_base (184)..(184): a, c, t, g, unknown or other
  modified_base (195)..(195): a, c, t, g, unknown or other
  modified_base (256)..(256): a, c, t, g, unknown or other
  modified_base (276)..(276): a, c, t, g, unknown or other
  modified_base (316)..(316): a, c, t, g, unknown or other
  modified_base (623)..(623): a, c, t, g, unknown or other
  misc_feature (679)..(681): This region may encompass 'ctc' or is absent in its entirety
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaantgacccctggnagagccaggcgcagcacagacagaaagccctgcctgaaagtgactggagccaagagcctgncactctcggctcattccgtncagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggnctccttggaaccrgctggacatggcggtgacgggacctagtctgcgagtcgagtcctctgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4805 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcrcagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4806 - DNA, 142 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (61)..(61): a, c, t, g, unknown or other
  modified_base (72)..(72): a, c, t, g, unknown or other
  modified_base (79)..(79): a, c, t, g, unknown or other
  modified_base (86)..(86): a, c, t, g, unknown or other
  modified_base (94)..(94): a, c, t, g, unknown or other
  modified_base (122)..(122): a, c, t, g, unknown or other
  modified_base (126)..(126): a, c, t, g, unknown or other
  modified_base (130)..(130): a, c, t, g, unknown or other
  modified_base (141)..(141): a, c, t, g, unknown or other
ctcctntataggagatancakcagaacataggtttgaagcagtcacastgtgccagaaatnagtttcttcanaactcanagaaganagggaagncatcatactaaacctctactgagcctcnggtncccnaaactaacagnc

SEQ ID NO: 4807 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggyggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4808 - DNA, 174 bp, Artificial Sequence
  Description of Artificial Sequence: Synthetic polynucleotide
  modified_base (24)..(24): a, c, t, g, unknown or other
  modified_base (51)..(51): a, c, t, g, unknown or other
  modified_base (57)..(57): a, c, t, g, unknown or other
  modified_base (85)..(85): a, c, t, g, unknown or other
  modified_base (103)..(103): a, c, t, g, unknown or other
  modified_base (107)..(107): a, c, t, g, unknown or other
  modified_base (111)..(111): a, c, t, g, unknown or other
  modified_base (124)..(124): a, c, t, g, unknown or other
  modified_base (126)..(126): a, c, t, g, unknown or other
  modified_base (129)..(129): a, c, t, g, unknown or other
  modified_base (135)..(135): a, c, t, g, unknown or other
aaagattatgatgcactggcctgntctawgacttcactgcattcatcagcncagganacaaagacatgcacttttttcataattnttttagtaataattgacnattngagnaaatgaatggcanrnaanaattangggcagacaagatggtcagcaaatcaaactgggaaatgc

SEQ ID NO: 4809 - DNA, 182 bp, Artificial Sequence
  Description of Artificial Sequence: Synthetic polynucleotide
  modified_base (12)..(12): a, c, t, g, unknown or other
  modified_base (61)..(61): a, c, t, g, unknown or other
  modified_base (93)..(93): a, c, t, g, unknown or other
  modified_base (157)..(157): a, c, t, g, unknown or other
cgcatgcctgancaataagcttggccagaaatacttcattaccatattgtttacwcattangaggtacgaagtagagatgagacttcatcaanatctcgaaggttttttgcagaacaacrtaccaaattaggaagaatctcatgagcttttctgcangctatttcataaccttctatgacct

SEQ ID NO: 4810 - DNA, 522 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (73)..(73): a, c, t, g, unknown or other
  modified_base (76)..(76): a, c, t, g, unknown or other
  modified_base (90)..(90): a, c, t, g, unknown or other
  modified_base (98)..(98): a, c, t, g, unknown or other
  modified_base (112)..(112): a, c, t, g, unknown or other
  modified_base (123)..(123): a, c, t, g, unknown or other
  modified_base (167)..(167): a, c, t, g, unknown or other
  modified_base (175)..(175): a, c, t, g, unknown or other
  modified_base (190)..(190): a, c, t, g, unknown or other
  modified_base (197)..(197): a, c, t, g, unknown or other
  modified_base (239)..(239): a, c, t, g, unknown or other
  modified_base (241)..(241): a, c, t, g, unknown or other
  modified_base (281)..(281): a, c, t, g, unknown or other
  modified_base (333)..(333): a, c, t, g, unknown or other
  modified_base (336)..(336): a, c, t, g, unknown or other
  modified_base (359)..(359): a, c, t, g, unknown or other
  modified_base (389)..(389): a, c, t, g, unknown or other
  modified_base (392)..(392): a, c, t, g, unknown or other
  modified_base (399)..(399): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (446)..(446): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (475)..(475): a, c, t, g, unknown or other
  modified_base (497)..(497): a, c, t, g, unknown or other
  modified_base (499)..(499): a, c, t, g, unknown or other
  modified_base (509)..(509): a, c, t, g, unknown or other
  modified_base (513)..(513): a, c, t, g, unknown or other
gnacagcgtgcagganactccagaacgctgcatatttctctgcatttygtgtgtatgacaagccatgtggggnttnttatttccatcaancactaganaaatccattcygcncgattctatcnagttgttgccttcctagaaacacaggaataacctgcagcaccanccccttcngttctgtggcattgncacaatnaggaatctacttttgtgcttttacacattgaactgacaggtnanrtcaggcatcgactgtcacaggggccagtggagaggtrgnagggacgcccacattcgatgaatcctgcatcayggtgttggacttcttgttnttngacactaaacttgttcacattynataacttgagcacgaataaaggcagctcanagnaataacncctgatgggnacnggccctgtgctntgctctaaacactgctcctgtnacccctncaagacatgggnccngcatttnacaaacatgaattctgaagacnangaataactgntctngcccakctc

SEQ ID NO: 4811 - DNA, 1048 bp, Artificial Sequence
  Description of Artificial Sequence: Synthetic polynucleotide
  modified_base (2)..(2): a, c, t, g, unknown or other
  modified_base (71)..(71): a, c, t, g, unknown or other
  modified_base (93)..(93): a, c, t, g, unknown or other
  modified_base (95)..(95): a, c, t, g, unknown or other
  modified_base (106)..(106): a, c, t, g, unknown or other
  modified_base (141)..(141): a, c, t, g, unknown or other
  modified_base (146)..(146): a, c, t, g, unknown or other
  modified_base (180)..(180): a, c, t, g, unknown or other
  modified_base (191)..(191): a, c, t, g, unknown or other
  modified_base (193)..(193): a, c, t, g, unknown or other
  modified_base (216)..(216): a, c, t, g, unknown or other
  modified_base (225)..(225): a, c, t, g, unknown or other
  modified_base (244)..(244): a, c, t, g, unknown or other
  modified_base (276)..(276): a, c, t, g, unknown or other
  modified_base (316)..(316): a, c, t, g, unknown or other
  modified_base (343)..(343): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (391)..(391): a, c, t, g, unknown or other
  modified_base (493)..(493): a, c, t, g, unknown or other
  modified_base (601)..(601): a, c, t, g, unknown or other
  modified_base (603)..(603): a, c, t, g, unknown or other
  modified_base (640)..(640): a, c, t, g, unknown or other
  modified_base (680)..(680): a, c, t, g, unknown or other
  modified_base (684)..(684): a, c, t, g, unknown or other
  modified_base (711)..(711): a, c, t, g, unknown or other
  modified_base (725)..(725): a, c, t, g, unknown or other
  modified_base (752)..(752): a, c, t, g, unknown or other
  modified_base (788)..(788): a, c, t, g, unknown or other
  modified_base (991)..(991): a, c, t, g, unknown or other
  modified_base (994)..(994): a, c, t, g, unknown or other
  modified_base (1005)..(1005): a, c, t, g, unknown or other
  modified_base (1023)..(1023): a, c, t, g, unknown or other
  modified_base (1029)..(1029): a, c, t, g, unknown or other
tncattgagtgaacaagggaagcagctagytatccaggtgtctaatatcctggggatggatgtgtgtggcnttgayctgytgatgaaagatgncngctccttctgngtctgtgaggccaatgcaaatgtaggtttcatcrnctttnataaggcttgtaatctagatgtagctggtatcanagcrgactatncngcctcccttctaccctctggccngctcacccngcgtatgtccctgctctcnrtggtgtccactgccagtgagactagtgagcnggagctgggtcccccagccagcactgctgttgacaacatnagtgcaagttccagctctgttgacagngaccctgaaagcanggagcgagagckgctcaccaanctcccagggngnctgttcaacatgaaccarctgctagccaatgaaatcaaactactggtggactgactccactggtaattaaccaacaaaacccttgtaaaactttctttcttncttttctatttttraaaccaacttgcaatgctgttcatggaggatgctcaggaagatgagagaaaattagtaggattagttggagagagtgggagatagaygagaccncngctagtaagatgttactttcatttacaaatcctacangagaggyagaataggtggggtatagaaaaatgtcaggctntcangttacccttttaaattgctaaaaaatntgtatgctcatagnccatgaggaacaaatactttttttttncatggtcccttgcttttgtttttgtacaaaaaaaantggttttgctacaaatatccaagtagcataacttcacattgtgttggaagatttgtcatcagtgaggaaaacatctgcwtaaattacaggaatttttgtattatacagctctgaaaattctgccatttccttattaactagcagctttagtttgtagtttatgaaatcttgaggggctcttttactgrgatttcttatttttnttngttttttcccncttaatttggtgggaggntcaaantgaatataacccaataaag

SEQ ID NO: 4812 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcrttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4813 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagraatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4814 - DNA, 162 bp, Artificial Sequence
  Description of Artificial Sequence: Synthetic polynucleotide
  modified_base (27)..(27): a, c, t, g, unknown or other
  modified_base (72)..(72): a, c, t, g, unknown or other
  modified_base (75)..(75): a, c, t, g, unknown or other
  modified_base (139)..(139): a, c, t, g, unknown or other
gataaggctcaattacttgaaatagcnaaarctaatgcagctgccatgtgtgctaaggctggtgtccctttnccnccaaacctaaagcctgcacctccacctactatagwwgagaaagttgctaaaaagtcargagganctactatagaagaactaactgag

SEQ ID NO: 4815 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (458)..(458): a, c, t, g, unknown or other
  modified_base (743)..(743): a, c, t, g, unknown or other
  modified_base (1028)..(1028): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1729)..(1729): a, c, t, g, unknown or other
  misc_feature (1822)..(1822): May or may not be present
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattnacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttccttttcagaaactccaaagttggctggctatmttctttcttgctgcrtttcatgcctcacaatccctcttccttagccaaaataatgtcnacatctgtggtcttgattcttcccattcaayatctttta

SEQ ID NO: 4816 - DNA, 151 bp, Artificial Sequence
  Description of Artificial Sequence: Synthetic polynucleotide
  modified_base (2)..(2): a, c, t, g, unknown or other
  modified_base (11)..(11): a, c, t, g, unknown or other
  modified_base (41)..(41): a, c, t, g, unknown or other
  modified_base (76)..(76): a, c, t, g, unknown or other
  modified_base (143)..(143): a, c, t, g, unknown or other
  modified_base (148)..(148): a, c, t, g, unknown or other
tnatcagaacngagtccctggtatagccaccgtcatattcngtagtttcttctagtgcttggaaatctagattctnggcttccacatataagcaattcaatttcttctggtctgartaagtactttaagggagattcattggncaccntat

SEQ ID NO: 4817 - DNA, 1869 bp, Artificial Sequence
  Description of Artificial Sequence: Synthetic polynucleotide
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgytcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4818 - DNA, 150 bp, Artificial Sequence
  Description of Artificial Sequence: Synthetic polynucleotide
  modified_base (77)..(77): a, c, t, g, unknown or other
  modified_base (113)..(113): a, c, t, g, unknown or other
  modified_base (149)..(149): a, c, t, g, unknown or other
ctacatccaggacttctccaccaaatctcagttaattctactgggtaaataygtaaatataaaagaagtcttctatntcaaaacaaaagtggtaaagaagataaaatctaganagccctacttagaaaaccatgagcttatttactacna

SEQ ID NO: 4819 - DNA, 570 bp, Artificial Sequence
  Description of Artificial Sequence: Synthetic polynucleotide
  modified_base (15)..(15): a, c, t, g, unknown or other
  modified_base (53)..(53): a, c, t, g, unknown or other
  modified_base (140)..(140): a, c, t, g, unknown or other
  modified_base (150)..(150): a, c, t, g, unknown or other
  modified_base (167)..(167): a, c, t, g, unknown or other
  modified_base (183)..(183): a, c, t, g, unknown or other
  modified_base (213)..(213): a, c, t, g, unknown or other
  modified_base (232)..(232): a, c, t, g, unknown or other
  modified_base (236)..(236): a, c, t, g, unknown or other
  modified_base (273)..(273): a, c, t, g, unknown or other
  modified_base (295)..(295): a, c, t, g, unknown or other
  modified_base (301)..(301): a, c, t, g, unknown or other
  modified_base (346)..(346): a, c, t, g, unknown or other
  modified_base (366)..(366): a, c, t, g, unknown or other
  modified_base (382)..(382): a, c, t, g, unknown or other
  modified_base (391)..(391): a, c, t, g, unknown or other
  modified_base (422)..(422): a, c, t, g, unknown or other
  modified_base (432)..(432): a, c, t, g, unknown or other
  modified_base (455)..(455): a, c, t, g, unknown or other
  modified_base (474)..(474): a, c, t, g, unknown or other
  modified_base (508)..(508): a, c, t, g, unknown or other
  modified_base (532)..(532): a, c, t, g, unknown or other
  modified_base (549)..(549): a, c, t, g, unknown or other
  modified_base (555)..(555): a, c, t, g, unknown or other
gtcatataaacattnagtcttccaaaatttttcaccaaaktttacttcctcanagactcctggaaaacaaaaggactctcttgttctctgaatactctccatccttgcctcaatttagatatgctcaagatggaagcacncagartgtgncttgatctgactccaanctgatctagaattganggctgttaggaagactrttctcacacatanttgtactttgaaaggtggntctnaaattgtctggaggcccatggccaatatcaacagrgntttgtgaggaaagagatccccntagtancagtgagcattgtcatgcacagcatgaatgctcaataaatgtacnaaattgaactaaaatrtttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgngatacagaaaaggggtntgtgtncctgagacttctccc

SEQ ID NO: 4820 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggsaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4821 - DNA, 340 bp, Artificial Sequence
  Description of Artificial Sequence: Synthetic polynucleotide
  modified_base (32)..(32): a, c, t, g, unknown or other
  modified_base (95)..(95): a, c, t, g, unknown or other
  modified_base (101)..(101): a, c, t, g, unknown or other
  misc_feature (109)..(111): This region may encompass 'gaa' or is absent in its entirety
  modified_base (282)..(282): a, c, t, g, unknown or other
ctatatagatcacatagcaatawggaaaaacngatacgtcaagtgagtatactgtgtttayggcttygttaaaacgtggaaaatacaaaaaaaangggaanatgaaaagaaaatcaaagcagggaaaaggctaayacgttttctttcaatatatatttttaaagttttatcaaacaaaaatatagaraatttgtcacttgaaaaagctactgccagtaaattgtaccaagttttggtacaatagtagcaaatttgatttttaatttgtgttgtttttttttngatakgagagctttaaattaatagttttttgagattctcacaattaattgcaattttc

SEQ ID NO: 4822 - DNA, 363 bp, Artificial Sequence
  Description of Artificial Sequence: Synthetic polynucleotide
  modified_base (15)..(15): a, c, t, g, unknown or other
  modified_base (29)..(29): a, c, t, g, unknown or other
  modified_base (55)..(55): a, c, t, g, unknown or other
  modified_base (78)..(78): a, c, t, g, unknown or other
  modified_base (89)..(89): a, c, t, g, unknown or other
  modified_base (125)..(125): a, c, t, g, unknown or other
  modified_base (137)..(137): a, c, t, g, unknown or other
  modified_base (139)..(139): a, c, t, g, unknown or other
  modified_base (147)..(147): a, c, t, g, unknown or other
  modified_base (198)..(198): a, c, t, g, unknown or other
  modified_base (226)..(226): a, c, t, g, unknown or other
  modified_base (243)..(243): a, c, t, g, unknown or other
  modified_base (296)..(296): a, c, t, g, unknown or other
  modified_base (304)..(304): a, c, t, g, unknown or other
  modified_base (314)..(314): a, c, t, g, unknown or other
  modified_base (326)..(326): a, c, t, g, unknown or other
  modified_base (328)..(328): a, c, t, g, unknown or other
  modified_base (345)..(345): a, c, t, g, unknown or other
atcttcytcacagtnttggacctcctagngggaaaaaaagtgcaccttttcttanctcttccagagtgttctctagtncatgctacttncaagttctttccccaaacttttctcacctatgtttncctatggggctntngaytcagnttcatgrgcaatgtgttcctataaagaagaaggagtgtagggycaccttcngcttatgttttagctctagaggatgagngaagagccaacgtgtgncagtttgaggatggatgtacagtgagtagtgaggggctttttccaccttgaanrcatgagngctcttgagnccctcccactgnanttcagagtcaccagatntgtgcatgatatctctgc

SEQ ID NO: 4823 - DNA, 225 bp, Artificial Sequence
  Description of Artificial Sequence: Synthetic polynucleotide
  modified_base (9)..(9): a, c, t, g, unknown or other
  modified_base (26)..(26): a, c, t, g, unknown or other
  modified_base (66)..(66): a, c, t, g, unknown or other
  modified_base (211)..(211): a, c, t, g, unknown or other
tgtcagccnctctcctccccagatancgctctgtcatcagccaaggaacaaattccccatgaaagncattattctttctctcaagaagatcaactacttatatttcttcctttgctgacagctttgcagggtgaacatctagaatttaaaaaagggttgatgkggacaagtgagctctctgtgtgactcaccaggatgttccctcttattncaggtgtcctgtcc

SEQ ID NO: 4824 - DNA, 946 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  misc_feature (139)..(140): This region may encompass 'ac' or 'gt'
  modified_base (150)..(150): a, c, t, g, unknown or other
  modified_base (160)..(160): a, c, t, g, unknown or other
  modified_base (229)..(246): a, c, t, g, unknown or other
  modified_base (248)..(249): a, c, t, g, unknown or other
  modified_base (272)..(272): a, c, t, g, unknown or other
  modified_base (288)..(288): a, c, t, g, unknown or other
  modified_base (343)..(343): a, c, t, g, unknown or other
  modified_base (345)..(345): a, c, t, g, unknown or other
  modified_base (359)..(359): a, c, t, g, unknown or other
  modified_base (379)..(379): a, c, t, g, unknown or other
  modified_base (386)..(386): a, c, t, g, unknown or other
  modified_base (426)..(426): a, c, t, g, unknown or other
  modified_base (458)..(458): a, c, t, g, unknown or other
  modified_base (467)..(467): a, c, t, g, unknown or other
  modified_base (486)..(486): a, c, t, g, unknown or other
  modified_base (505)..(505): a, c, t, g, unknown or other
  modified_base (529)..(529): a, c, t, g, unknown or other
  modified_base (592)..(592): a, c, t, g, unknown or other
  modified_base (602)..(602): a, c, t, g, unknown or other
  modified_base (606)..(606): a, c, t, g, unknown or other
  modified_base (615)..(615): a, c, t, g, unknown or other
  modified_base (665)..(665): a, c, t, g, unknown or other
  modified_base (670)..(670): a, c, t, g, unknown or other
  modified_base (703)..(703): a, c, t, g, unknown or other
  modified_base (752)..(752): a, c, t, g, unknown or other
  modified_base (777)..(777): a, c, t, g, unknown or other
  modified_base (806)..(806): a, c, t, g, unknown or other
  modified_base (824)..(824): a, c, t, g, unknown or other
  modified_base (826)..(826): a, c, t, g, unknown or other
  modified_base (839)..(839): a, c, t, g, unknown or other
  modified_base (850)..(850): a, c, t, g, unknown or other
  modified_base (877)..(877): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccryaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagangactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4825 - DNA, 1290 bp, Artificial Sequence
  Description of Artificial Sequence: Synthetic polynucleotide
  modified_base (173)..(173): a, c, t, g, unknown or other
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  modified_base (623)..(623): a, c, t, g, unknown or other
  modified_base (833)..(833): a, c, t, g, unknown or other
  modified_base (1049)..(1049): a, c, t, g, unknown or other
  modified_base (1099)..(1099): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctantgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattrtttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4826 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaawattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4827 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgasgaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4828 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcrgcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4829 - DNA, 240 bp, Artificial Sequence
  Description of Artificial Sequence: Synthetic polynucleotide
  modified_base (13)..(13): a, c, t, g, unknown or other
  modified_base (16)..(16): a, c, t, g, unknown or other
  modified_base (26)..(26): a, c, t, g, unknown or other
  modified_base (38)..(38): a, c, t, g, unknown or other
  modified_base (45)..(45): a, c, t, g, unknown or other
  modified_base (52)..(52): a, c, t, g, unknown or other
  modified_base (58)..(58): a, c, t, g, unknown or other
  modified_base (83)..(83): a, c, t, g, unknown or other
  modified_base (102)..(102): a, c, t, g, unknown or other
  modified_base (144)..(144): a, c, t, g, unknown or other
  modified_base (150)..(150): a, c, t, g, unknown or other
  modified_base (162)..(162): a, c, t, g, unknown or other
  modified_base (175)..(175): a, c, t, g, unknown or other
  modified_base (181)..(181): a, c, t, g, unknown or other
  modified_base (191)..(191): a, c, t, g, unknown or other
  modified_base (228)..(228): a, c, t, g, unknown or other
  modified_base (233)..(233): a, c, t, g, unknown or other
ccccatttccctnaangtaggattcnagggcacaagcngaggagnaaagggntgtcangtcagaaccgcctagaaggcaacgngaagcagaagcgcaggccngcgagatgctcwtcagagtgacttagctgtgggctgcggaangcaacngaaggaactcancatccactggccncattcnctccccggancrgaggacagagccgagtttcttcaggcagtggctcngccanctctgcc

SEQ ID NO: 4830 - DNA, 100 bp, Artificial Sequence
  Description of Artificial Sequence: Synthetic polynucleotide
  modified_base (26)..(26): a, c, t, g, unknown or other
  modified_base (35)..(35): a, c, t, g, unknown or other
  modified_base (37)..(37): a, c, t, g, unknown or other
  modified_base (44)..(44): a, c, t, g, unknown or other
  modified_base (46)..(46): a, c, t, g, unknown or other
  modified_base (50)..(50): a, c, t, g, unknown or other
  modified_base (75)..(75): a, c, t, g, unknown or other
gagaaagggccaggagctgagacttngagcctatncnaaaaagngntttngcaaggagcatgccaagtkgaaccntactgcaggggtggcttttgaatac

SEQ ID NO: 4831 - DNA, 295 bp, Artificial Sequence
  Description of Artificial Sequence: Synthetic polynucleotide
  modified_base (6)..(6): a, c, t, g, unknown or other
  modified_base (13)..(13): a, c, t, g, unknown or other
  modified_base (21)..(21): a, c, t, g, unknown or other
  modified_base (25)..(25): a, c, t, g, unknown or other
  modified_base (30)..(30): a, c, t, g, unknown or other
  modified_base (57)..(57): a, c, t, g, unknown or other
  modified_base (71)..(71): a, c, t, g, unknown or other
  modified_base (130)..(130): a, c, t, g, unknown or other
  modified_base (147)..(147): a, c, t, g, unknown or other
  modified_base (175)..(175): a, c, t, g, unknown or other
  modified_base (178)..(178): a, c, t, g, unknown or other
  modified_base (237)..(237): a, c, t, g, unknown or other
  modified_base (245)..(245): a, c, t, g, unknown or other
  modified_base (259)..(259): a, c, t, g, unknown or other
  modified_base (263)..(263): a, c, t, g, unknown or other
  modified_base (272)..(272): a, c, t, g, unknown or other
  modified_base (280)..(280): a, c, t, g, unknown or other
catgtnatagttnagtttttnttcnttttnatttkgcctgctttgyaaatgtcattntaggtgcttgcttnataacagaatagcagaattgatgcaactacattaaaacagaaagggagacayagtgtcnggctgccttgggcattnctgttarcagaaatggaagtctttcagnggncttaatttttaatagctatgctatcagattctcagtcttggcattagggctaggtgttngaacttcncataaagtgttytnattnatggactcnctgctccntaccataaaatgaag

SEQ ID NO: 4832 - DNA, 570 bp, Artificial Sequence
  Description of Artificial Sequence: Synthetic polynucleotide
  modified_base (15)..(15): a, c, t, g, unknown or other
  modified_base (53)..(53): a, c, t, g, unknown or other
  modified_base (140)..(140): a, c, t, g, unknown or other
  modified_base (150)..(150): a, c, t, g, unknown or other
  modified_base (167)..(167): a, c, t, g, unknown or other
  modified_base (183)..(183): a, c, t, g, unknown or other
  modified_base (213)..(213): a, c, t, g, unknown or other
  modified_base (232)..(232): a, c, t, g, unknown or other
  modified_base (236)..(236): a, c, t, g, unknown or other
  modified_base (271)..(271): a, c, t, g, unknown or other
  modified_base (295)..(295): a, c, t, g, unknown or other
  modified_base (301)..(301): a, c, t, g, unknown or other
  modified_base (346)..(346): a, c, t, g, unknown or other
  modified_base (366)..(366): a, c, t, g, unknown or other
  modified_base (382)..(382): a, c, t, g, unknown or other
  modified_base (391)..(391): a, c, t, g, unknown or other
  modified_base (422)..(422): a, c, t, g, unknown or other
  modified_base (432)..(432): a, c, t, g, unknown or other
  modified_base (455)..(455): a, c, t, g, unknown or other
  modified_base (474)..(474): a, c, t, g, unknown or other
  modified_base (508)..(508): a, c, t, g, unknown or other
  modified_base (532)..(532): a, c, t, g, unknown or other
  modified_base (549)..(549): a, c, t, g, unknown or other
  modified_base (555)..(555): a, c, t, g, unknown or other
gtcatataaacattnagtcttccaaaatttttcaccaaaktttacttcctcanagactcctggaaaacaaaaggactctcttgttctctgaatactctccatccttgcctcaatttagatatgctcaagatggaagcacncagartgtgncttgatctgactccaanctgatctagaattganggctgttaggaagactrttctcacacatanttgtactttgaaaggtggntctnaaattgtctggaggcccatggccaatatcaacagngytttgtgaggaaagagatccccntagtancagtgagcattgtcatgcacagcatgaatgctcaataaatgtacnaaattgaactaaaatrtttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgngatacagaaaaggggtntgtgtncctgagacttctccc

SEQ ID NO: 4833 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagyctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4834 - DNA, 353 bp, Artificial Sequence
  Description of Artificial Sequence: Synthetic polynucleotide
  modified_base (144)..(144): a, c, t, g, unknown or other
  modified_base (185)..(231): a, c, t, g, unknown or other
  modified_base (235)..(235): a, c, t, g, unknown or other
  misc_feature (271)..(274): This region may encompass 'tcaa' or is absent in its entirety
  modified_base (313)..(313): a, c, t, g, unknown or other
  modified_base (318)..(318): a, c, t, g, unknown or other
  modified_base (336)..(336): a, c, t, g, unknown or other
  modified_base (350)..(350): a, c, t, g, unknown or other
ccacactcatcatcgtcattactccyattactatgamgtgaagagttgtgctgctaggacrggagcagcaacttttcaacaccaatcrcttttttagayggcctcctttctagccttgttagttgcccaaattctgaaaaaaancaagaactaagactctagaaggagatccgagaggcagacrnnnnnnnnnnnnnnnnnnnnnnnnnnnnnnnnnnnnnnnnnnnnnnnagangaaggaggaatcaggagtaatgccaagaatgagaatcaaatctgtataagcagttcagaaaaggggcatcatgagtcnctctnctcagtgctgccccaagngttccacagtttgntcc

SEQ ID NO: 4835 - DNA, 243 bp, Artificial Sequence
  Description of Artificial Sequence: Synthetic polynucleotide
  modified_base (20)..(20): a, c, t, g, unknown or other
  modified_base (25)..(25): a, c, t, g, unknown or other
  modified_base (36)..(36): a, c, t, g, unknown or other
  modified_base (40)..(40): a, c, t, g, unknown or other
  modified_base (64)..(64): a, c, t, g, unknown or other
  modified_base (69)..(69): a, c, t, g, unknown or other
  modified_base (107)..(107): a, c, t, g, unknown or other
  modified_base (117)..(117): a, c, t, g, unknown or other
  modified_base (120)..(120): a, c, t, g, unknown or other
  modified_base (180)..(180): a, c, t, g, unknown or other
  modified_base (201)..(201): a, c, t, g, unknown or other
  modified_base (210)..(210): a, c, t, g, unknown or other
agactcatcaacttctcatnatcyntactaccacanacancagaatatctaaaacccctagagnccaanccactccagtccatgtttgagttttccaaatccacatncatttgaagngtngaattttccatgcaktgtgttttgaaatcaacagacatatacttaatccttttgcctcantttctgatcatcataaagaynggaaaaacngaaatcctcagttcattttaattctcttagtcc

SEQ ID NO: 4836 - DNA, 371 bp, Artificial Sequence
  Description of Artificial Sequence: Synthetic polynucleotide
  modified_base (13)..(13): a, c, t, g, unknown or other
  modified_base (27)..(27): a, c, t, g, unknown or other
  modified_base (50)..(50): a, c, t, g, unknown or other
  modified_base (108)..(108): a, c, t, g, unknown or other
  modified_base (137)..(253): a, c, t, g, unknown or other
  modified_base (297)..(297): a, c, t, g, unknown or other
  modified_base (319)..(319): a, c, t, g, unknown or other
  modified_base (367)..(367): a, c, t, g, unknown or other
ctttctaaaaacncataacataccaanaacagacattcttgagataaaantaggaaaaagaaacctatctgacaatgactggtttacaataaagatcctgaaaagatnamccccactccagctcaccagggagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaattatgactcaagactacagagagaactacagaagaattnaacagcagagaaagatgatcantcttcaaatggttcaaaggacaaacctttcaatccatgaaaaactctnggta

SEQ ID NO: 4837 - DNA, 109 bp, Artificial Sequence
  Description of Artificial Sequence: Synthetic polynucleotide
  modified_base (50)..(50): a, c, t, g, unknown or other
  modified_base (89)..(89): a, c, t, g, unknown or other
  modified_base (95)..(95): a, c, t, g, unknown or other
  modified_base (98)..(98): a, c, t, g, unknown or other
taccttgctgcatgagagctccaactccaaaccagaaactatttagyaangtaaaattgttttccaccacgtctgagtcagggttgcangggtgnggnttataccactc

SEQ ID NO: 4838 - DNA, 653 bp, Artificial Sequence
  Description of Artificial Sequence: Synthetic polynucleotide
  modified_base (2)..(2): a, c, t, g, unknown or other
  modified_base (14)..(14): a, c, t, g, unknown or other
  modified_base (30)..(30): a, c, t, g, unknown or other
  modified_base (48)..(48): a, c, t, g, unknown or other
  modified_base (50)..(50): a, c, t, g, unknown or other
  modified_base (61)..(61): a, c, t, g, unknown or other
  modified_base (74)..(74): a, c, t, g, unknown or other
  modified_base (100)..(100): a, c, t, g, unknown or other
  modified_base (106)..(106): a, c, t, g, unknown or other
  modified_base (108)..(108): a, c, t, g, unknown or other
  modified_base (165)..(165): a, c, t, g, unknown or other
  modified_base (171)..(171): a, c, t, g, unknown or other
  modified_base (249)..(249): a, c, t, g, unknown or other
  modified_base (257)..(257): a, c, t, g, unknown or other
  modified_base (265)..(265): a, c, t, g, unknown or other
  modified_base (276)..(276): a, c, t, g, unknown or other
  modified_base (278)..(322): a, c, t, g, unknown or other
  modified_base (353)..(353): a, c, t, g, unknown or other
  modified_base (382)..(382): a, c, t, g, unknown or other
  modified_base (412)..(412): a, c, t, g, unknown or other
  modified_base (426)..(426): a, c, t, g, unknown or other
  modified_base (433)..(455): a, c, t, g, unknown or other
  modified_base (510)..(510): a, c, t, g, unknown or other
  modified_base (550)..(550): a, c, t, g, unknown or other
  modified_base (574)..(574): a, c, t, g, unknown or other
  modified_base (577)..(577): a, c, t, g, unknown or other
  modified_base (615)..(615): a, c, t, g, unknown or other
antttctaggtttnaaaatccaaatttaanaatgctgttcagaaatanyngtgtgttttantattaataacatngcaataaaaattctaatctatttaanttcagngntttagaaaaagaccatgtactaccaaaataatttcatctgtttgaaaytgcattttncatatnaaaatggcacaagttccttttatattaaatrcattgaaaaccctcagcttcacacatttgaatatttctattttactnacaatttntttactantgggaactacncnnnnnnnnnnnnnnnnnnnnnnnnnnnnnnnnnnnnnnnnnnnnnctccttttcatcaccagaaagaatgytttanttcctatttaatggaaccatccatttttngtctttaagtcatatataattttttctttnctattcctccattntttctgnnnnnnnnnnnnnnnnnnnnnnngtcaattgttttgctatctgaagaatgcaaaccacaactgcttctgaagaccctnatcatatctagcttttaacctaccagttatgcacctagcntcaaaaacaccatttcctccgagnttnacaagcctactgaaatcaccatagttctttagtaagcntcagaagcctggagtatggatgtatatttttctcctgt

SEQ ID NO: 4839 - DNA, 631 bp, Artificial Sequence
  Description of Artificial Sequence: Synthetic polynucleotide
  modified_base (37)..(37): a, c, t, g, unknown or other
  modified_base (58)..(58): a, c, t, g, unknown or other
  modified_base (61)..(61): a, c, t, g, unknown or other
  modified_base (89)..(89): a, c, t, g, unknown or other
  modified_base (102)..(102): a, c, t, g, unknown or other
  modified_base (134)..(134): a, c, t, g, unknown or other
  modified_base (138)..(138): a, c, t, g, unknown or other
  modified_base (144)..(144): a, c, t, g, unknown or other
  modified_base (148)..(148): a, c, t, g, unknown or other
  modified_base (171)..(171): a, c, t, g, unknown or other
  modified_base (177)..(177): a, c, t, g, unknown or other
  modified_base (191)..(191): a, c, t, g, unknown or other
  modified_base (201)..(201): a, c, t, g, unknown or other
  modified_base (205)..(205): a, c, t, g, unknown or other
  modified_base (215)..(215): a, c, t, g, unknown or other
  modified_base (231)..(231): a, c, t, g, unknown or other
  modified_base (256)..(256): a, c, t, g, unknown or other
  modified_base (295)..(295): a, c, t, g, unknown or other
  modified_base (327)..(327): a, c, t, g, unknown or other
  modified_base (353)..(353): a, c, t, g, unknown or other
  modified_base (356)..(356): a, c, t, g, unknown or other
  modified_base (392)..(392): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (447)..(447): a, c, t, g, unknown or other
  modified_base (454)..(454): a, c, t, g, unknown or other
  modified_base (480)..(480): a, c, t, g, unknown or other
  modified_base (486)..(486): a, c, t, g, unknown or other
  modified_base (493)..(493): a, c, t, g, unknown or other
  modified_base (529)..(529): a, c, t, g, unknown or other
  modified_base (546)..(546): a, c, t, g, unknown or other
  modified_base (554)..(554): a, c, t, g, unknown or other
  modified_base (570)..(570): a, c, t, g, unknown or other
  modified_base (575)..(575): a, c, t, g, unknown or other
  modified_base (590)..(590): a, c, t, g, unknown or other
  modified_base (617)..(617): a, c, t, g, unknown or other
  modified_base (620)..(620): a, c, t, g, unknown or other
ctgaaacagcaattgggaggcccattttactggccantatataattmcattagtaagnagnctagcaaagaataatcatatcaatttcntaatcagctgcanccatgctgaatttgaactggcaaactctgatntgtnagttgntagntgtgatcttcatatcactaaaangaacangataccattctaanaactttacanaganatagtctagnagacattgttctgccntggtcacagtaacaaaaaagtggtnaaaatcagttactttataaatactgataatttgcagcantaaggaacaggacattaaaaaaartaaatttncccataggacacctatgactaggaantcnttcctaagagaagccaaagttttaattattcagttncacaactantgtactgggttacntantctaagaaagaaaaggtgctctacagagntttcccncacacacaaagaatcagcrttaattnagcatnatctctntcattcacagatctggcagattcattaactcatttnaaatgaataaggccaanaggatgcnggaaggtgtggctgantgagntccagggctgtatcncagcttattgatggcaccccattaggnaantgaatacraag

SEQ ID NO: 4840 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  modified_base (76)..(76): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaangccatggrcccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4841 - DNA, 167 bp, Artificial Sequence
  Description of Artificial Sequence: Synthetic polynucleotide
  modified_base (26)..(26): a, c, t, g, unknown or other
  modified_base (88)..(88): a, c, t, g, unknown or other
  modified_base (98)..(98): a, c, t, g, unknown or other
agaatttattgccatgtacacttacnagagttctgagcaaggagatttaacctttcagcaaggrgatgtgattttggttaccaagaangatggtgacnggtggacaggaacagtgggcgacaaggccggagtcttcccttctaactatgtgaggcttaaagattcag

SEQ ID NO: 4842 - DNA, 1104 bp, Artificial Sequence
  Description of Artificial Sequence: Synthetic polynucleotide
  modified_base (6)..(6): a, c, t, g, unknown or other
  modified_base (18)..(18): a, c, t, g, unknown or other
  modified_base (23)..(23): a, c, t, g, unknown or other
  modified_base (46)..(46): a, c, t, g, unknown or other
  modified_base (62)..(62): a, c, t, g, unknown or other
  modified_base (76)..(76): a, c, t, g, unknown or other
  modified_base (88)..(88): a, c, t, g, unknown or other
  modified_base (109)..(109): a, c, t, g, unknown or other
  modified_base (176)..(176): a, c, t, g, unknown or other
  modified_base (196)..(196): a, c, t, g, unknown or other
  modified_base (232)..(232): a, c, t, g, unknown or other
  modified_base (245)..(245): a, c, t, g, unknown or other
  modified_base (255)..(255): a, c, t, g, unknown or other
  modified_base (317)..(317): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
  modified_base (537)..(537): a, c, t, g, unknown or other
  modified_base (595)..(595): a, c, t, g, unknown or other
  modified_base (616)..(616): a, c, t, g, unknown or other
  modified_base (620)..(620): a, c, t, g, unknown or other
  modified_base (644)..(644): a, c, t, g, unknown or other
  modified_base (646)..(646): a, c, t, g, unknown or other
  modified_base (664)..(664): a, c, t, g, unknown or other
  modified_base (667)..(667): a, c, t, g, unknown or other
  modified_base (710)..(710): a, c, t, g, unknown or other
  modified_base (717)..(717): a, c, t, g, unknown or other
  modified_base (797)..(797): a, c, t, g, unknown or other
  modified_base (808)..(808): a, c, t, g, unknown or other
  modified_base (813)..(813): a, c, t, g, unknown or other
  modified_base (821)..(821): a, c, t, g, unknown or other
  modified_base (840)..(840): a, c, t, g, unknown or other
  modified_base (901)..(901): a, c, t, g, unknown or other
  modified_base (964)..(964): a, c, t, g, unknown or other
  modified_base (987)..(987): a, c, t, g, unknown or other
  modified_base (1056)..(1056): a, c, t, g, unknown or other
  modified_base (1094)..(1094): a, c, t, g, unknown or other
atggangcccttaccagncccanttgtatgtttttcttgaataggnattgakaaatggaagngcttaccagcccanctttgccagccntaataagaagcatgctaaagncacagcagctactgtggttcytcaagcaatgggccttgtaccaaaggacctcatggctaatgccacntgcttcaggagtgcctcacntagatagattgaggttttataataatcatttcaganattttactctgcntcacaatgtntttcctctttaatgttgtaaatatttggcaatttaagacattgtgtaaaaagcaatctgtanaaacatctccaggctttgatttttgtaccatggraattgtatttaaccatacagggttttggtatgtttatattgtttancttagtgatgtatttgtttragtggctaacatccaaacgantgtttgaaggcatnagagtaatcttcagtgtggaatgttaaataaygcttttatactgtattttgtactatgatgtaactccccttccttatggctagnctactgtaacacttgcctgtaatcagtgaagggctgtgcaccttgtactatttcacantgggttctgctggacagatantggnccagtgttattgaggtgatcaagnanctgttccacagggctaangcnaccatctcccctcaaaattttgtagaggytctaaaaagaaagnggtatgngtgtgatgatcagcactaagtcctgcattcctgttaaagccacttgggtcataagaagggagtaaaaaatgaagtctgantagaattctanttgcngaggccangtacatttagtatggcatngagttgtgatatagttttactttgatgtgcattttgaatttcagctacacctagatagacntaaratgataattaaaatgctgtaaccaacttatctaataaaattggcaaccagccactattntgttgactaygagaaagttaaangtttatgttaatttttagggtctgatagratatttcatgtgtattacagtggtattcatatgctatgtntctaaactttattttcaaaagcttaaggcccaaatacnaacttctctg

SEQ ID NO: 4843 - DNA, 122 bp, Artificial Sequence
  Description of Artificial Sequence: Synthetic polynucleotide
  modified_base (38)..(38): a, c, t, g, unknown or other
  modified_base (58)..(58): a, c, t, g, unknown or other
  modified_base (61)..(61): a, c, t, g, unknown or other
  modified_base (64)..(64): a, c, t, g, unknown or other
  modified_base (67)..(67): a, c, t, g, unknown or other
  modified_base (89)..(89): a, c, t, g, unknown or other
  modified_base (99)..(99): a, c, t, g, unknown or other
  modified_base (105)..(105): a, c, t, g, unknown or other
  modified_base (118)..(118): a, c, t, g, unknown or other
ctggggacactaaacaaagacaggttcaaaaatacwtnmggatgtttctggaacaatntgnganranagcaaattcacattacaaatanaacaagcacngagaanatgcagcaaaagntaga

SEQ ID NO: 4844 - DNA, 439 bp, Artificial Sequence
  Description of Artificial Sequence: Synthetic polynucleotide
  modified_base (3)..(3): a, c, t, g, unknown or other
  modified_base (57)..(57): a, c, t, g, unknown or other
  modified_base (80)..(80): a, c, t, g, unknown or other
  modified_base (159)..(159): a, c, t, g, unknown or other
  modified_base (217)..(217): a, c, t, g, unknown or other
tantctactgcaaataatacgtttcataaaatgcttaataaaaactttcaataccancatgaaagcaattagaacatganggtgtctgaastagatcatagtagtgtgattacattcaatatctttctataagacgtgatgatacatacagggtaaatnatacaagaagacctaagattattatctcagaatttcctaattagaatgggaatacaantgtgcaatgagagaaatggactgaagacagaaataaaaacaaatgttatgatttaatatgacaaatttaaaatttccactttattttccaccatttttaaagagcattccttayagtattmaktttaatgcatttttaaaaatcagtaagacaagtagcacatttctctagttcarractccrctttcagggttacagttaaagatgatcctagaagtgcat

SEQ ID NO: 4845 - DNA, 102 bp, Artificial Sequence
  Description of Artificial Sequence: Synthetic polynucleotide
  misc_feature (31)..(33): This region may encompass 'aag' or is absent in its entirety
  modified_base (94)..(94): a, c, t, g, unknown or other
catgraaacaatgggttctagaaaaaaaaaaaggctgatatttctaatacagtaagaaaatagatgtaattgtcaactccraaggaggtcattnactagcac

SEQ ID NO: 4846 - DNA, 101 bp, Artificial Sequence
  Description of Artificial Sequence: Synthetic polynucleotide
  modified_base (48)..(48): a, c, t, g, unknown or other
  modified_base (71)..(71): a, c, t, g, unknown or other
atatagtgtctcatagtcactggtccatagtaagtatwaaaaaattgngatcaagtgaatatatacattanattaatatcaggcttctctataaaatttaa

SEQ ID NO: 4847 - DNA, 945 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (22)..(22): a, c, t, g, unknown or other
  modified_base (60)..(60): a, c, t, g, unknown or other
  modified_base (139)..(139): a, c, t, g, unknown or other
  modified_base (149)..(149): a, c, t, g, unknown or other
  modified_base (159)..(159): a, c, t, g, unknown or other
  modified_base (228)..(245): a, c, t, g, unknown or other
  modified_base (247)..(248): a, c, t, g, unknown or other
  modified_base (271)..(271): a, c, t, g, unknown or other
  modified_base (287)..(287): a, c, t, g, unknown or other
  modified_base (342)..(342): a, c, t, g, unknown or other
  modified_base (344)..(344): a, c, t, g, unknown or other
  modified_base (358)..(358): a, c, t, g, unknown or other
  modified_base (378)..(378): a, c, t, g, unknown or other
  modified_base (385)..(385): a, c, t, g, unknown or other
  modified_base (425)..(425): a, c, t, g, unknown or other
  modified_base (457)..(457): a, c, t, g, unknown or other
  modified_base (466)..(466): a, c, t, g, unknown or other
  modified_base (485)..(485): a, c, t, g, unknown or other
  modified_base (504)..(504): a, c, t, g, unknown or other
  modified_base (528)..(528): a, c, t, g, unknown or other
  modified_base (591)..(591): a, c, t, g, unknown or other
  modified_base (601)..(601): a, c, t, g, unknown or other
  modified_base (605)..(605): a, c, t, g, unknown or other
  modified_base (614)..(614): a, c, t, g, unknown or other
  modified_base (664)..(664): a, c, t, g, unknown or other
  modified_base (669)..(669): a, c, t, g, unknown or other
  modified_base (702)..(702): a, c, t, g, unknown or other
  modified_base (751)..(751): a, c, t, g, unknown or other
  modified_base (805)..(805): a, c, t, g, unknown or other
  modified_base (823)..(823): a, c, t, g, unknown or other
  modified_base (825)..(825): a, c, t, g, unknown or other
  modified_base (838)..(838): a, c, t, g, unknown or other
  modified_base (849)..(849): a, c, t, g, unknown or other
  modified_base (876)..(876): a, c, t, g, unknown or other
attcagattcntanatacacanaaaattgttttattgagatgacaaagtatatttattangccacccagaatataatccactctgataactgccagtttatgcacttgctgaagtaactcagtacataaatagtagccnaacagttgcngtgcatgaangttcttctcttccagattgaagagtgtacaatctaamgcattttaaaactttaaatcccttattagcynnnnnnnnnnnnnnnnnnynngtttgccttacctataatttgtnacactaggttactaanggtgatatgattacatatgtggacacaaaataattttaatggaaaatgaaattangntactcaacaaaganaaagggtaatgatcatgtanactaacngtatttgagattagtttaagcctggggtagctatacttangtttcacagacctggagaagataggaaaaaangcttttatnaacattgctaaggaacagntaaaagctaacattaggtnactaagaggtgacataaaaaagantgaataaaatawcatggaggtttcataatragattggaaattcaatagactaggagaaaaaanatcccaaaanatanatgctcatngggaaaacacatagtaagaaaaaggagagatctctatttaatgatacaanagtangagttataatttcctgtataatgtaaatttcangcatttaaacattttcattgaattataaaatactatttggaaaagaaanaacagcacaactgcagattacagawgactaagatagatgaatcatgaaaaggtnctagcagagatttctatnanacctatcaggganacacaatttcnaagaatttcagaagtstttggtgttcntattaacgtaaatcctgaaataacacctgagtgaactgtcttctaattcttcaactggatggcttttta

SEQ ID NO: 4848 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  misc_feature (1630)..(1630): May or may not be present
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggccccccaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4849 - DNA, 162 bp, Artificial Sequence
  Description of Artificial Sequence: Synthetic polynucleotide
  modified_base (2)..(2): a, c, t, g, unknown or other
  modified_base (16)..(16): a, c, t, g, unknown or other
  modified_base (27)..(27): a, c, t, g, unknown or other
  modified_base (67)..(67): a, c, t, g, unknown or other
  modified_base (99)..(99): a, c, t, g, unknown or other
  modified_base (101)..(101): a, c, t, g, unknown or other
  modified_base (125)..(125): a, c, t, g, unknown or other
  modified_base (130)..(130): a, c, t, g, unknown or other
anctacatcgtyatcntggcctgggcnacakactacctgttccagtccttccagaaggagctgcccngggcacactgcaaccacagctggaacacrccncnctgcatggaggacaccatgcgcangaacnagagtgtctggatcaccatcagctccaccaac

SEQ ID NO: 4850 - DNA, 327 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (33)..(33): a, c, t, g, unknown or other
  modified_base (45)..(45): a, c, t, g, unknown or other
  modified_base (53)..(53): a, c, t, g, unknown or other
  modified_base (58)..(58): a, c, t, g, unknown or other
  modified_base (70)..(70): a, c, t, g, unknown or other
  modified_base (81)..(81): a, c, t, g, unknown or other
  modified_base (126)..(126): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (151)..(151): a, c, t, g, unknown or other
  modified_base (159)..(159): a, c, t, g, unknown or other
  modified_base (165)..(165): a, c, t, g, unknown or other
  modified_base (168)..(168): a, c, t, g, unknown or other
  modified_base (170)..(170): a, c, t, g, unknown or other
  modified_base (203)..(203): a, c, t, g, unknown or other
  modified_base (208)..(208): a, c, t, g, unknown or other
  modified_base (210)..(210): a, c, t, g, unknown or other
  modified_base (212)..(212): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (282)..(282): a, c, t, g, unknown or other
  modified_base (292)..(292): a, c, t, g, unknown or other
  modified_base (294)..(294): a, c, t, g, unknown or other
  modified_base (301)..(301): a, c, t, g, unknown or other
  modified_base (321)..(321): a, c, t, g, unknown or other
cactttggcattgtgatttaaaatgtnctncangatgggataatnatatgttnacaanggatataagganagtagacaggnatggtattcttacagccatgttcccaccagggtcaagagaamagnacaaagccnagncangccagggccnttccaaangggccncantncccctctggaggctgctgacctggagacctgcnatggncncntcttgccagctctccttcctctttctccagangncngcccagccttgctagctatatwttacacccaacngagcagagcnanactgganaataatcaaatgtttccccnttttaa

SEQ ID NO: 4851 - DNA, 100 bp, Artificial Sequence
  Description of Artificial Sequence: Synthetic polynucleotide
  modified_base (10)..(10): a, c, t, g, unknown or other
  modified_base (50)..(50): a, c, t, g, unknown or other
  modified_base (57)..(57): a, c, t, g, unknown or other
  modified_base (60)..(60): a, c, t, g, unknown or other
  modified_base (85)..(85): a, c, t, g, unknown or other
  modified_base (91)..(91): a, c, t, g, unknown or other
  modified_base (93)..(93): a, c, t, g, unknown or other
ttcgaattcngctgaagctcaagcaagcaaggcagagaaarggctaatcngacccanggngagatcccaccacctactccttcgncgcacngngattcaa

SEQ ID NO: 4852 - DNA, 316 bp, Artificial Sequence
  Description of Artificial Sequence: Synthetic polynucleotide
  modified_base (10)..(10): a, c, t, g, unknown or other
  modified_base (20)..(20): a, c, t, g, unknown or other
  modified_base (22)..(22): a, c, t, g, unknown or other
  modified_base (29)..(29): a, c, t, g, unknown or other
  modified_base (35)..(35): a, c, t, g, unknown or other
  modified_base (37)..(37): a, c, t, g, unknown or other
  modified_base (63)..(63): a, c, t, g, unknown or other
  modified_base (122)..(122): a, c, t, g, unknown or other
  modified_base (130)..(130): a, c, t, g, unknown or other
  modified_base (134)..(134): a, c, t, g, unknown or other
  modified_base (138)..(138): a, c, t, g, unknown or other
  modified_base (159)..(159): a, c, t, g, unknown or other
  modified_base (164)..(164): a, c, t, g, unknown or other
  modified_base (178)..(178): a, c, t, g, unknown or other
  modified_base (187)..(187): a, c, t, g, unknown or other
  modified_base (190)..(190): a, c, t, g, unknown or other
  modified_base (240)..(240): a, c, t, g, unknown or other
  modified_base (245)..(245): a, c, t, g, unknown or other
  modified_base (262)..(262): a, c, t, g, unknown or other
  modified_base (274)..(274): a, c, t, g, unknown or other
  modified_base (286)..(286): a, c, t, g, unknown or other
  modified_base (312)..(312): a, c, t, g, unknown or other
ctggactaanatgtgtgtyngnttttttntttgtntnttttcactcagaatgattccttccwnggggmttctgagtctcctccctaccccattgtctagccctttaaatacatttgacaatnaagttctntctnttcnccagacatatttggacatgtngaatnccagcaagagaagnagtttgttnttncccctgaaggcttccagctgtgtgcaagcagacttccacagatgccayancatcncttagcagatgtgttcngatatttctaantccacctaattnaagctgaaaattctcaattgtgttanaaaa

SEQ ID NO: 4853 - DNA, 2632 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  misc_feature (2321)..(2322): This region may encompass 'tg' or 'ca'
  modified_base (2343)..(2343): a, c, t, g, unknown or other
  modified_base (2426)..(2426): a, c, t, g, unknown or other
  modified_base (2438)..(2438): a, c, t, g, unknown or other
  modified_base (2442)..(2442): a, c, t, g, unknown or other
  modified_base (2451)..(2451): a, c, t, g, unknown or other
  modified_base (2498)..(2498): a, c, t, g, unknown or other
  modified_base (2504)..(2504): a, c, t, g, unknown or other
  modified_base (2541)..(2541): a, c, t, g, unknown or other
  modified_base (2565)..(2565): a, c, t, g, unknown or other
  modified_base (2567)..(2567): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccyrgtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4854 - DNA, 198 bp, Artificial Sequence
  Description of Artificial Sequence: Synthetic polynucleotide
  modified_base (21)..(21): a, c, t, g, unknown or other
  modified_base (80)..(80): a, c, t, g, unknown or other
  modified_base (83)..(83): a, c, t, g, unknown or other
  modified_base (139)..(139): a, c, t, g, unknown or other
  modified_base (161)..(161): a, c, t, g, unknown or other
  modified_base (186)..(186): a, c, t, g, unknown or other
tatcaagtactttgtccattngcaggcagrtgttaaatacagcagttggctcgtgtggatacagtactgcagagaaaganccnctctgtgaagatttgagcagcatggtcagtgaatgcagagaatgaggcaygatagnacctgtaatctccaaactaaantggtctctgtatccagaaagagctngtgtcttcacat

SEQ ID NO: 4855 - DNA, 541 bp, Artificial Sequence
  Description of Artificial Sequence: Synthetic polynucleotide
  modified_base (57)..(57): a, c, t, g, unknown or other
  modified_base (174)..(174): a, c, t, g, unknown or other
  modified_base (260)..(260): a, c, t, g, unknown or other
gtggtaaaaatccagtgccctaaacccatatccagagctgtgagagtttttcactgnctaatttacagttttcttgcatcagagaaaaaataaggctcagaaactaggtattcgatttgcccaaaactctcatcagatagaaaatccattccctaactttctagctagtattanttccataaagttagatcagtatcactccgaaaataaatacacgtcacccagtatatttctcccaaataaaagaggargcaaggcgntttacaacccagtgatgggctaccacatcaacacaggaaagaggtgccaagctcctttactcccgtccataaccctacacagaaaagagtgggtgcagtggaatgaggctgggtggagagaagttcctcttcttactgacaaaatagatcacagggcatcacgtaatatgtaaaagtctttataatacagcatattattttctttggaaaaccttttctaatattttggtatcagtaaaaaccctcagatgaatttcaaacactataaaaatacaatacat

SEQ ID NO: 4856 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtrggcttttctggcttcctcttcagcaactgcatg

SEQ ID NO: 4857 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaayacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4858 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggwgggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4859 - DNA, 151 bp, Artificial Sequence
  Description of Artificial Sequence: Synthetic polynucleotide
  modified_base (8)..(8): a, c, t, g, unknown or other
  modified_base (34)..(34): a, c, t, g, unknown or other
  modified_base (42)..(42): a, c, t, g, unknown or other
  modified_base (68)..(68): a, c, t, g, unknown or other
  modified_base (70)..(70): a, c, t, g, unknown or other
  modified_base (85)..(85): a, c, t, g, unknown or other
  modified_base (89)..(89): a, c, t, g, unknown or other
  modified_base (91)..(91): a, c, t, g, unknown or other
  modified_base (115)..(115): a, c, t, g, unknown or other
  modified_base (119)..(119): a, c, t, g, unknown or other
  modified_base (137)..(137): a, c, t, g, unknown or other
  modified_base (143)..(143): a, c, t, g, unknown or other
gtacaagngaaacattcatcagaatgtgacccancctgaaanaggagggaggaaaatctttaaragtntnacaggtaaggtcccnaaancncaaaataataagggggtaatgtanattnctcacccagtcttggcancaattntgtrcttt

SEQ ID NO: 4860 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagktatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4861 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtayttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4862 - DNA, 692 bp, Artificial Sequence
  Description of Artificial Sequence: Synthetic polynucleotide
  modified_base (2)..(2): a, c, t, g, unknown or other
  modified_base (36)..(36): a, c, t, g, unknown or other
  modified_base (60)..(60): a, c, t, g, unknown or other
  modified_base (103)..(103): a, c, t, g, unknown or other
  modified_base (131)..(131): a, c, t, g, unknown or other
  modified_base (143)..(143): a, c, t, g, unknown or other
  misc_feature (149)..(149): May or may not be present
  modified_base (175)..(175): a, c, t, g, unknown or other
  modified_base (212)..(212): a, c, t, g, unknown or other
  modified_base (215)..(215): a, c, t, g, unknown or other
  modified_base (222)..(222): a, c, t, g, unknown or other
  modified_base (224)..(224): a, c, t, g, unknown or other
  modified_base (238)..(238): a, c, t, g, unknown or other
  modified_base (241)..(241): a, c, t, g, unknown or other
  modified_base (311)..(311): a, c, t, g, unknown or other
  modified_base (322)..(322): a, c, t, g, unknown or other
  modified_base (337)..(337): a, c, t, g, unknown or other
  modified_base (370)..(370): a, c, t, g, unknown or other
  modified_base (404)..(404): a, c, t, g, unknown or other
  modified_base (434)..(434): a, c, t, g, unknown or other
  modified_base (446)..(446): a, c, t, g, unknown or other
  modified_base (453)..(453): a, c, t, g, unknown or other
  modified_base (472)..(472): a, c, t, g, unknown or other
  modified_base (482)..(482): a, c, t, g, unknown or other
  modified_base (491)..(491): a, c, t, g, unknown or other
  modified_base (514)..(514): a, c, t, g, unknown or other
  modified_base (522)..(522): a, c, t, g, unknown or other
  modified_base (529)..(529): a, c, t, g, unknown or other
  modified_base (539)..(539): a, c, t, g, unknown or other
  modified_base (568)..(568): a, c, t, g, unknown or other
  modified_base (584)..(584): a, c, t, g, unknown or other
  modified_base (621)..(621): a, c, t, g, unknown or other
  modified_base (626)..(626): a, c, t, g, unknown or other
  modified_base (632)..(632): a, c, t, g, unknown or other
  modified_base (653)..(653): a, c, t, g, unknown or other
  modified_base (661)..(661): a, c, t, g, unknown or other
  modified_base (664)..(664): a, c, t, g, unknown or other
  modified_base (666)..(666): a, c, t, g, unknown or other
cncagtcaagtaaaaagaaacgcaactaaaagagcngtcagttaaatacattcctctctntggcaggacragtctataagatttgttttgtttttaatttagnagtttttttaatgtttaaaccttgtganacatcaaattanatgcttgaagctgttactttctgtcaaaaaangtgagtttttaatatgaaaattctgcttaggttaaanttnaaaaagncnagttttatacatcngcntgaattgtttcctttagcactagtcaaacagactccataaccttccaaagaagtgccttcrtttatttangggcttagganaggaaaaaagctctnaaaagggaaatttcaaaatagggcttcagcagnggcccaggtggagtgagtagttttgataaggtcnggtgggactcacttccaggtggtgaggacngctctcccygantctctynatcggcctgctctgggccncagagactgnccctgacgncttctcagctcccggtcagcccngtcacccngggccanttcttcatcntacctggagacagaaacagccaggatcanggcaggctctctttcnaaggcaacaggcagggccaccaggctgctgtgtggcnaatangacatnacccagagaagcggcctgagngggccccnccngnctcctgctggctcccrcccacctccc

SEQ ID NO: 4863 - DNA, 371 bp, Artificial Sequence
  Description of Artificial Sequence: Synthetic polynucleotide
  modified_base (24)..(24): a, c, t, g, unknown or other
  modified_base (30)..(30): a, c, t, g, unknown or other
  misc_feature (103)..(104): This region may encompass 'ca' or 'tg'
  modified_base (132)..(132): a, c, t, g, unknown or other
  modified_base (136)..(136): a, c, t, g, unknown or other
  modified_base (176)..(176): a, c, t, g, unknown or other
  modified_base (200)..(200): a, c, t, g, unknown or other
  modified_base (238)..(238): a, c, t, g, unknown or other
  modified_base (241)..(241): a, c, t, g, unknown or other
  modified_base (259)..(259): a, c, t, g, unknown or other
  modified_base (352)..(352): a, c, t, g, unknown or other
taaaagagggaagatgacttttcntaaagngtggaataaagaaaagtaagatagcggatagaagcttgaagtgaaagcaggttcacaggaagtttctttggtyrtttgttttgtttttaaatagtggaaagntgtntatgtttatggagaaagattgccttgaagatgcaagaggnagagatgatcaaaattcaagaagnagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 4864 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctarygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4865 - DNA, 152 bp, Artificial Sequence
  Description of Artificial Sequence: Synthetic polynucleotide
  modified_base (19)..(19): a, c, t, g, unknown or other
  modified_base (69)..(69): a, c, t, g, unknown or other
  misc_feature (78)..(82): This region may encompass 'cttta' or is absent in its entirety
  modified_base (134)..(134): a, c, t, g, unknown or other
  modified_base (137)..(137): a, c, t, g, unknown or other
  modified_base (148)..(148): a, c, t, g, unknown or other
  modified_base (150)..(150): a, c, t, g, unknown or other
agcattttgacttaaaaanttattgggcaagtactgtgtgcaggatgctcctaagtaattggcagtggntataaatactttaagcaatttttccaaccctatgctgggaagaattcctgccacaacatatcatnaanggtagtaagrncnta

SEQ ID NO: 4866 - DNA, 522 bp, Artificial Sequence
  Description of Artificial Sequence: Synthetic polynucleotide
  modified_base (26)..(26): a, c, t, g, unknown or other
  modified_base (174)..(174): a, c, t, g, unknown or other
  modified_base (245)..(285): a, c, t, g, unknown or other
  modified_base (337)..(337): a, c, t, g, unknown or other
  modified_base (399)..(399): a, c, t, g, unknown or other
  modified_base (408)..(408): a, c, t, g, unknown or other
  modified_base (440)..(440): a, c, t, g, unknown or other
  modified_base (489)..(489): a, c, t, g, unknown or other
  modified_base (493)..(493): a, c, t, g, unknown or other
agtagatacattttayatagaatttngttaagtattccttaaaatatcactttaatatgccayaagaataaccacagaatagtgttactttaaagtaaaaagatayaaatagragcccaaaatgttaagtggggttttacaatcaagaagacacaccagaataagatatttttnaaataccatgtacrttaaagagatcatacttccttaccctaataaayagccatgtagtacaagttttaacnnnnnnnnnnnnnnnnnnnnnnnnnnnnnnnnnnnnnnnnncaacttctatttggttttayctgagccattcctttatactgacagttacatnatgtgatttcagttatatatgtagttwttggtaatttttcaaaaatagaatataatgaaaancttcatttnaatcattactgaactgcacctacattaatcanatatacctatgaaaagatgtataacatatactagtatgccaaaaaaaanaagnkacaaaacagtatttatagtataattcca

SEQ ID NO: 4867 - DNA, 1484 bp, Artificial Sequence
  Description of Artificial Sequence: Synthetic polynucleotide
  modified_base (66)..(66): a, c, t, g, unknown or other
  modified_base (133)..(133): a, c, t, g, unknown or other
  modified_base (142)..(142): a, c, t, g, unknown or other
  modified_base (214)..(214): a, c, t, g, unknown or other
  modified_base (267)..(267): a, c, t, g, unknown or other
  modified_base (329)..(329): a, c, t, g, unknown or other
  modified_base (353)..(353): a, c, t, g, unknown or other
  modified_base (416)..(416): a, c, t, g, unknown or other
  modified_base (637)..(637): a, c, t, g, unknown or other
  modified_base (646)..(646): a, c, t, g, unknown or other
  modified_base (684)..(684): a, c, t, g, unknown or other
  modified_base (703)..(703): a, c, t, g, unknown or other
  modified_base (722)..(722): a, c, t, g, unknown or other
  modified_base (887)..(887): a, c, t, g, unknown or other
  modified_base (935)..(935): a, c, t, g, unknown or other
  modified_base (984)..(984): a, c, t, g, unknown or other
  modified_base (1022)..(1022): a, c, t, g, unknown or other
  modified_base (1052)..(1052): a, c, t, g, unknown or other
  modified_base (1203)..(1203): a, c, t, g, unknown or other
  modified_base (1299)..(1299): a, c, t, g, unknown or other
  modified_base (1343)..(1343): a, c, t, g, unknown or other
  modified_base (1366)..(1366): a, c, t, g, unknown or other
  modified_base (1376)..(1376): a, c, t, g, unknown or other
  modified_base (1476)..(1476): a, c, t, g, unknown or other
  modified_base (1482)..(1482): a, c, t, g, unknown or other
attttagtatatasgttctaatatttggggtattcctagaaatgtgtacctattattcacttgctnatatatatagcaaagtgaattttatatataattcttcaacatatttttagaaaaattaagttttttntagaaaatnaagagaattttagataaaaactcaacttttaatggaaaatattktcctttttctttctcacatgaaatyctntatcaaggttagtatcctacctggyatctctccaatastgggttaagagtttnttcttctcaagtaacctgtattatattaagatgatattaactgaaataatcagatagatgantgcrycataaagctaattctaagntatctgtccttagccaaaagcagaaaagggatacacataactyccacataaaacatccacccncatttttttggttattcttaaaagctcataatgtatacaatgataaaatttattgtttcaaattagggtttttgaaattgaaatattaatttaaacacgtttgcttaacacaactttaaagttaataagaaaacactgchtattacagaagagttaaatacttcaaaaagtgggaaaraatttaaaagctttcatttkagtaggagtaaacacagacacantaagaatcntagttggatacactkaaatcatgtcttttaagaacatnagaacagattatttgcttnctctttagtccaaaacctnggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaagntgagtcaataaggtgaaccagattctggttgaatggaatccttgaaanataactttggtgaacaaactgtttgtgttttccacttttcttaaaaaangaagtgataaagcagatttccagtacctgccarctganaaaatgytacttaccaggtaaaaaccaytnccaaaaatcagaatcacagaagggctatcagtaaaaytaytaatgccacaaattaacatgatgttaacwgctgawttatgcatcaaaagagtatttatataatcacagcaaataactcaaatcttttacatcactagtaaactcaaaaaanatagmaaaaagcaataacattaaatttcmttattgatctactagctttaactatttaatactagtacacttagttttgattactttgaaattgaancaaaaacaataatcttttcttcttttaatgactttttcagttanaggaaagatgatattaaaagaanatatacaacnatagcttagctacaggtataaaaytgttttaaagatatgtaattgtgctattgaattaaactgaaaacataaatatcaactcatgattttgaaaaaaaantctttnat

SEQ ID NO: 4868 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  misc_feature (42)..(42): May or may not be present
  modified_base (103)..(103): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (170)..(170): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (464)..(464): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaaatggtgaaaaattatcaggtgaagatccaaaagaagattaaagtgcagaaaagtgaatccanctgagakggtaatttttcccttgggnattagctgctnaggacctggccagcacttttganggcttcncagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgangtancatgtgtgntgcaaaagggaattttatttattatgctaaggaatttagaggaaaacattgcagctttg

SEQ ID NO: 4869 - DNA, 111 bp, Artificial Sequence
  Description of Artificial Sequence: Synthetic polynucleotide
  modified_base (53)..(53): a, c, t, g, unknown or other
  modified_base (62)..(62): a, c, t, g, unknown or other
  modified_base (69)..(69): a, c, t, g, unknown or other
  modified_base (77)..(77): a, c, t, g, unknown or other
  modified_base (106)..(106): a, c, t, g, unknown or other
taggtagagttgcaaataatttggtgagwggtgcagatggaggtatctcttanctgtgaggnaataagncaagtaanttgctgagaaaaatgtgggtgggagaaantggca

SEQ ID NO: 4870 - DNA, 829 bp, Artificial Sequence
  Description of Artificial Sequence: Synthetic polynucleotide
  modified_base (4)..(4): a, c, t, g, unknown or other
  modified_base (13)..(13): a, c, t, g, unknown or other
  modified_base (18)..(18): a, c, t, g, unknown or other
  modified_base (21)..(21): a, c, t, g, unknown or other
  modified_base (53)..(53): a, c, t, g, unknown or other
  modified_base (67)..(67): a, c, t, g, unknown or other
  modified_base (69)..(69): a, c, t, g, unknown or other
  modified_base (86)..(86): a, c, t, g, unknown or other
  modified_base (95)..(95): a, c, t, g, unknown or other
  modified_base (117)..(117): a, c, t, g, unknown or other
  modified_base (120)..(120): a, c, t, g, unknown or other
  modified_base (130)..(130): a, c, t, g, unknown or other
  modified_base (144)..(144): a, c, t, g, unknown or other
  misc_feature (184)..(185): This region may encompass 'ag' or 'gt'
  modified_base (208)..(208): a, c, t, g, unknown or other
  modified_base (212)..(212): a, c, t, g, unknown or other
  modified_base (224)..(224): a, c, t, g, unknown or other
  modified_base (229)..(229): a, c, t, g, unknown or other
  modified_base (232)..(232): a, c, t, g, unknown or other
  modified_base (258)..(258): a, c, t, g, unknown or other
  modified_base (280)..(280): a, c, t, g, unknown or other
  modified_base (285)..(285): a, c, t, g, unknown or other
  modified_base (293)..(293): a, c, t, g, unknown or other
  modified_base (314)..(314): a, c, t, g, unknown or other
  modified_base (321)..(321): a, c, t, g, unknown or other
  modified_base (323)..(323): a, c, t, g, unknown or other
  modified_base (326)..(326): a, c, t, g, unknown or other
  modified_base (339)..(339): a, c, t, g, unknown or other
  modified_base (373)..(494): a, c, t, g, unknown or other
  modified_base (500)..(500): a, c, t, g, unknown or other
  modified_base (522)..(522): a, c, t, g, unknown or other
  modified_base (550)..(550): a, c, t, g, unknown or other
  modified_base (558)..(558): a, c, t, g, unknown or other
  modified_base (566)..(566): a, c, t, g, unknown or other
  modified_base (570)..(592): a, c, t, g, unknown or other
  modified_base (594)..(594): a, c, t, g, unknown or other
  modified_base (611)..(611): a, c, t, g, unknown or other
  modified_base (651)..(651): a, c, t, g, unknown or other
  modified_base (687)..(687): a, c, t, g, unknown or other
  modified_base (721)..(721): a, c, t, g, unknown or other
  modified_base (747)..(747): a, c, t, g, unknown or other
  modified_base (765)..(765): a, c, t, g, unknown or other
  modified_base (787)..(787): a, c, t, g, unknown or other
  modified_base (789)..(789): a, c, t, g, unknown or other
  modified_base (804)..(804): a, c, t, g, unknown or other
  modified_base (806)..(806): a, c, t, g, unknown or other
  modified_base (822)..(822): a, c, t, g, unknown or other
tatncatgtgtantgcanacnttctttcttcctttctcatccttgcagtcgcnttctcttccttttncntctttcattccrtttangtgtcaaanaccacargtctgggaaaggaanaanatgtaagagnaagatgcctactangtgggcacatagagagctcctggtgggacagggactgcarkagaagagccactgcttggagagntttntcaaaaactctnccttnatntaaatgaatttcaacagcaaagtgangacatatccacacatttaaatnaaatncttccccntttccctggcakttaatatangaaatantntancatgtttatcaanggaaaacaccaccaaagacctgctttttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatngtcataattggtcctgtctaanatgagagccatggggaatgcccaattanattggytngtttcctnccannnnnnnnnnnnnnnnnnnnnnntntcctgatgaggtggttntccagatacttgtatctggtatccagattttctctgcttntccacagcaagaaatgatgtagggcatctctaggcngtcttttgcccctaatccagactcatgggtctcngggattaagggtcctccaccaattcntaagaccttcacctattntccttgttaccatcatcacaananttctgtttctgattncncctgctcctctcccanattttta

SEQ ID NO: 4871 - DNA, 124 bp, Artificial Sequence
  Description of Artificial Sequence: Synthetic polynucleotide
  modified_base (2)..(2): a, c, t, g, unknown or other
  modified_base (61)..(61): a, c, t, g, unknown or other
  modified_base (65)..(65): a, c, t, g, unknown or other
  modified_base (80)..(80): a, c, t, g, unknown or other
  modified_base (122)..(122): a, c, t, g, unknown or other
anctcagaattgtccatggcggctttcaatatgttggagtgtgcattgacagcctggaccncagnttctgagctgcaatngcctgcagagtgacayttgcagtttgcctcagagcatcttcnaa

SEQ ID NO: 4872 - DNA, 1946 bp, Artificial Sequence
  Description of Artificial Sequence: Synthetic polynucleotide
  modified_base (1)..(11): a, c, t, g, unknown or other
  modified_base (161)..(161): a, c, t, g, unknown or other
  modified_base (242)..(242): a, c, t, g, unknown or other
  modified_base (249)..(249): a, c, t, g, unknown or other
  modified_base (743)..(743): a, c, t, g, unknown or other
  modified_base (1028)..(1028): a, c, t, g, unknown or other
  modified_base (1276)..(1276): a, c, t, g, unknown or other
  modified_base (1344)..(1344): a, c, t, g, unknown or other
  modified_base (1349)..(1349): a, c, t, g, unknown or other
  modified_base (1353)..(1353): a, c, t, g, unknown or other
  modified_base (1409)..(1467): a, c, t, g, unknown or other
  modified_base (1592)..(1592): a, c, t, g, unknown or other
  modified_base (1729)..(1729): a, c, t, g, unknown or other
  modified_base (1822)..(1822): a, c, t, g, unknown or other
  modified_base (1907)..(1907): a, c, t, g, unknown or other
nnnnnnnnnnnagctaatcagaacaacagatttccttaggatgcttcaaatgactacagtcccatgaggtaaccaatgttaaaacacaattggcatgtcaaaattgaagctttccctgcagtaaagggtagaatttgaatcaatttttgaacagaaaaaantattagagtttaaaaatacaccttcttgaatctttaagtcatacagacattcccaatacaaaacattacagtatgaggacntgaaagngaaacacctgaaattaaagctactttttaaaaaaactaattaaaattcgtgttcttgtaagtaatcagtttttcaaatgtggataccactattgacattattaactcaaatatttccataatatttgaaaaataaacattggggagatgagactattaatatgtcaactattgaaatattcattttaatatagttgaactgtaaaattwacctgctctcaatgtttgtttattcttccattctaagcctttatttggaacagagttttgcatttcagtggcaggctaaacgggtttggaagaaaaatgattaataacgaatgtgtacttcacaaaatacatagttaataaataatgcaagataaaattataaaactcaatacctcaaagtgagaaggcttttcaggagactctaaaaagcaaaagagatttattatcrgtcataagtaaatatgacaaaaycagccacaaatgaatccagtgatagtatctaangtcctttttctcagctttgagaatgaytcctttaggtttagggggttttctttcggtatgtttctttaggacamtcacatgacagaaatacactgaagaaactaggaatctaggcttcatcaaacatgcacktaagacttcaaaagtgagaatgtgttgtgcatgcaaaatgtgttgatattaatatgtatatgctgagtgatgaaaagagaaatgatctttgatcagaggagcaaattatgacccagaaaaaataaatgtcaaagctgaatrtagaatcctacnccatatattcagtgaaatacactggaataatttatatcattacattaatcatgttctttaatttgtcctacaattgagatggtacaccgttatgatgagagttcagctgaatgcagaactgacatctcatcactgaacatgttacaaattgatcagcttggatatttacttaatggataatactaaataaaatattcattgtttcccatatccttgcagtgtaatcatatgcctacattgctgtatcntctagtttatcctcagaaattttcttgattcactcatgcaaaaaatactatraaactcattaaaaaanattgnatantgagctttcaatattgatatgtttatttgaaaatttatggcaacatacttatcacnnnnnnnnnnnnnnnnnnnnnnnnnnnnnnnnnnnnnnnnnnnnnnnnnnnnnnnnnnngaattcaagtaataaattctgtaattttttgtttctaaaaattagttggctttgtttattatggtaagtgtctaatagatttttatagaacaacaattttaccaaaacaatttgcttcattaaanataaagcyaatgctcttagattcaaatatctctcatttgaatagctaatatcaacaaaatataaacattttatgcctgatagtaatagagaaaactaatgagtcaccatggtttactccaattctagtaatcctccngcttccggtagtctctggagtacccacaatctaatcttctggagtgcaaatattgtaaatgcawctgaagtgaattcactcaaatttcctttncagaaactccaaagttggctggctatmttctttcttgctgcrtttcatgcctcacaatccctcttccttagccaaaataatgtcnacatctgtggtcttgattcttcccattcaayatctttta

SEQ ID NO: 4873 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (58)..(58): a, c, t, g, unknown or other
  modified_base (76)..(76): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacnttttagactatgatgatntccaccaattccttactgayaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4874 - DNA, 663 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (32)..(32): a, c, t, g, unknown or other
  modified_base (40)..(40): a, c, t, g, unknown or other
  modified_base (86)..(86): a, c, t, g, unknown or other
  modified_base (98)..(98): a, c, t, g, unknown or other
  modified_base (120)..(120): a, c, t, g, unknown or other
  modified_base (123)..(123): a, c, t, g, unknown or other
  modified_base (131)..(131): a, c, t, g, unknown or other
  modified_base (159)..(159): a, c, t, g, unknown or other
  modified_base (165)..(165): a, c, t, g, unknown or other
  modified_base (178)..(178): a, c, t, g, unknown or other
  modified_base (213)..(213): a, c, t, g, unknown or other
  modified_base (240)..(240): a, c, t, g, unknown or other
  modified_base (336)..(336): a, c, t, g, unknown or other
  modified_base (408)..(408): a, c, t, g, unknown or other
  modified_base (410)..(410): a, c, t, g, unknown or other
  modified_base (418)..(418): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
  modified_base (498)..(498): a, c, t, g, unknown or other
  modified_base (503)..(503): a, c, t, g, unknown or other
  modified_base (542)..(542): a, c, t, g, unknown or other
  modified_base (556)..(556): a, c, t, g, unknown or other
  modified_base (561)..(561): a, c, t, g, unknown or other
  modified_base (593)..(593): a, c, t, g, unknown or other
  modified_base (596)..(596): a, c, t, g, unknown or other
  modified_base (601)..(601): a, c, t, g, unknown or other
  modified_base (639)..(639): a, c, t, g, unknown or other
  modified_base (643)..(643): a, c, t, g, unknown or other
  modified_base (645)..(645): a, c, t, g, unknown or other
  modified_base (647)..(647): a, c, t, g, unknown or other
gaggatgggtttatattgggaaaanccaancntatcaaanttggtgaraacgaccacaggatgyaaccctctggcctgggacccancccatcaagtgngtgggggctgacaagaaaacancancggctccnggacagctcccagcagggctcactgctngscccngcctagcgctgantggggctgttcctggcccgacagcctcccgaggcngctgccaacaccgcacccttcccaccngtgtcctggaagtsctcagaggaaacatctgcccrgaacatgacatcastaaatcattaatgagacagtcactatatgacataaatccacttagcngagcctcacyctcacctagcaactgggtcaccagcaaactaaccacttrgtgtgactcttccattaggactncntggccccngagcctnagaggccaacgttcccaaccagggactccacccttctcccagagngaggcaaaaacaanacaatgtaactganaaccnggttgtaaaaaccggtggaagagctgggaacagttaacngggtgtctttcacntctgngtgtaggagccgaggtggagccgccagctgtncanagganccccctcctgggrggtaagagggctcgccagagccagnaggngngngggcagggtccctgtg

SEQ ID NO: 4875 - DNA, 150 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (45)..(45): a, c, t, g, unknown or other
  misc_feature (51)..(52): This region may encompass 'gg' or 'ac'
  modified_base (72)..(72): a, c, t, g, unknown or other
  modified_base (98)..(98): a, c, t, g, unknown or other
  modified_base (107)..(107): a, c, t, g, unknown or other
  modified_base (118)..(118): a, c, t, g, unknown or other
gatgaagnynacgttatttgctccactttccactgactggaatcntcttarsctcatctctgtagatgcctnaatrtcaccaacttctttcttcaagncagcctccncatcatcatcntctccctcacttccagagggctgctgatcctt

SEQ ID NO: 4876 - DNA, 324 bp, Artificial Sequence
  Description of Artificial Sequence: Synthetic polynucleotide
  modified_base (97)..(97): a, c, t, g, unknown or other
  modified_base (174)..(174): a, c, t, g, unknown or other
  modified_base (204)..(204): a, c, t, g, unknown or other
  modified_base (268)..(268): a, c, t, g, unknown or other
  modified_base (270)..(270): a, c, t, g, unknown or other
  modified_base (287)..(287): a, c, t, g, unknown or other
aattatttctttttgttgataagaatatgatattttgttggtaagaataggacatatggccttgcttagaagaaaggtgactaagaattgtagttcngaaggggagctattttccagtaacagctctacactctagaagaagatataagaaaattgatgaatacttagttcccngtaatttactctgtctcctataatctgagnttttaatttctccagtgcagtgkttatctgattatcctttgtagataatttcctttgtaagtananttctgtactagggagancttcacttttcttctttgtctactaacatacttcagg

SEQ ID NO: 4877 - DNA, 753 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  modified_base (673)..(673): a, c, t, g, unknown or other
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggraactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttngcacaaggtttttccccagttcctacccctttcctttcctctctgtccagcaaacctgcttgtttctgtcacctgccttc

SEQ ID NO: 4878 - DNA, 323 bp, Artificial Sequence
  Description of Artificial Sequence: Synthetic polynucleotide
  modified_base (8)..(8): a, c, t, g, unknown or other
  modified_base (13)..(13): a, c, t, g, unknown or other
  modified_base (28)..(28): a, c, t, g, unknown or other
  modified_base (32)..(32): a, c, t, g, unknown or other
  modified_base (37)..(37): a, c, t, g, unknown or other
  modified_base (62)..(62): a, c, t, g, unknown or other
  modified_base (71)..(71): a, c, t, g, unknown or other
  modified_base (75)..(75): a, c, t, g, unknown or other
  modified_base (80)..(80): a, c, t, g, unknown or other
  modified_base (109)..(109): a, c, t, g, unknown or other
  modified_base (160)..(160): a, c, t, g, unknown or other
  modified_base (165)..(165): a, c, t, g, unknown or other
  modified_base (171)..(171): a, c, t, g, unknown or other
  modified_base (191)..(191): a, c, t, g, unknown or other
  modified_base (195)..(195): a, c, t, g, unknown or other
  modified_base (203)..(203): a, c, t, g, unknown or other
  modified_base (221)..(221): a, c, t, g, unknown or other
  modified_base (255)..(255): a, c, t, g, unknown or other
  modified_base (273)..(273): a, c, t, g, unknown or other
  modified_base (285)..(285): a, c, t, g, unknown or other
  modified_base (309)..(309): a, c, t, g, unknown or other
tgaattantgaantatctaattaagcantctnccagntgttggacatttaggtcattccagnttttccttnctgnaacancctaaygatgagagaaccaaaagcttaantcmaatacagtcagaaggaaaattmtttcagttgaaggaatgaacattttncccancataanatgtaacaaattttagttcnatancaaaaatngaaaattggagttctttnctgatgatgggaaagaacaaaaagacaacatccncttgtggttcagagtganactgaaacctgnaaarggaaggagaatcccctaaanatgggtgcaggaat

SEQ ID NO: 4879 - DNA, 225 bp, Artificial Sequence
  Description of Artificial Sequence: Synthetic polynucleotide
  modified_base (1)..(24): a, c, t, g, unknown or other
  modified_base (26)..(26): a, c, t, g, unknown or other
  modified_base (69)..(69): a, c, t, g, unknown or other
  modified_base (95)..(95): a, c, t, g, unknown or other
  modified_base (112)..(112): a, c, t, g, unknown or other
nnnnnnnnnnnnnnnnnnnnnnnnangccagggagccttaaaaggtagttctctaagttaccaaaatcntattgttctccrgaatatatcattanaactaaaacagtgttgnacatgsagacccatccaaattatgtttgcccatgagctccataaagaagccaaatatgtgtgactctgttgccctgcaacaggcatctcctgactcctctggctggtcatctc

SEQ ID NO: 4880 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (273)..(273): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttngcctccaattattattcagttcarcctctccataaaaagtcacngttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatrctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4881 - DNA, 127 bp, Artificial Sequence
  Description of Artificial Sequence: Synthetic polynucleotide
  modified_base (3)..(3): a, c, t, g, unknown or other
  modified_base (68)..(68): a, c, t, g, unknown or other
  modified_base (93)..(93): a, c, t, g, unknown or other
  modified_base (113)..(113): a, c, t, g, unknown or other
canagtgcagtttaaaccaccatttctgtgaagctttctytgcctgttaccaggtactacccatacanacactacccacgaacaaagaaatgngcgttgttctgtgctgcacncaccattgtaacaa

SEQ ID NO: 4882 - DNA, 238 bp, Artificial Sequence
  Description of Artificial Sequence: Synthetic polynucleotide
  modified_base (154)..(154): a, c, t, g, unknown or other
  modified_base (185)..(185): a, c, t, g, unknown or other
  modified_base (200)..(230): a, c, t, g, unknown or other
agtcttgggtatttttaaaagactgtcttctctggctgatcagacatcatacgtctcctgagtaaactcacacagttcagcttatagctctacaaaatttttycttgattttagaagatttagcctttgtgtattcatcttactattcaataancaactcaagtgggccccatagaaacttctgnagagtttttctgttnnnnnnnnnnnnnnnnnnnnnnnnnnnnnnncctggatg

SEQ ID NO: 4883 - DNA, 722 bp, Artificial Sequence
  Description of Artificial Sequence: Synthetic polynucleotide
  modified_base (12)..(12): a, c, t, g, unknown or other
  modified_base (32)..(32): a, c, t, g, unknown or other
  modified_base (60)..(60): a, c, t, g, unknown or other
  modified_base (76)..(76): a, c, t, g, unknown or other
  modified_base (79)..(79): a, c, t, g, unknown or other
  modified_base (96)..(96): a, c, t, g, unknown or other
  modified_base (118)..(118): a, c, t, g, unknown or other
  modified_base (152)..(152): a, c, t, g, unknown or other
  modified_base (218)..(218): a, c, t, g, unknown or other
  modified_base (225)..(225): a, c, t, g, unknown or other
  modified_base (233)..(233): a, c, t, g, unknown or other
  modified_base (243)..(243): a, c, t, g, unknown or other
  modified_base (245)..(245): a, c, t, g, unknown or other
  modified_base (284)..(284): a, c, t, g, unknown or other
  modified_base (293)..(293): a, c, t, g, unknown or other
  modified_base (298)..(335): a, c, t, g, unknown or other
  modified_base (339)..(339): a, c, t, g, unknown or other
  modified_base (359)..(359): a, c, t, g, unknown or other
  modified_base (387)..(387): a, c, t, g, unknown or other
  modified_base (394)..(394): a, c, t, g, unknown or other
  modified_base (407)..(407): a, c, t, g, unknown or other
  modified_base (438)..(438): a, c, t, g, unknown or other
  modified_base (541)..(541): a, c, t, g, unknown or other
  modified_base (574)..(574): a, c, t, g, unknown or other
  modified_base (579)..(579): a, c, t, g, unknown or other
  modified_base (593)..(593): a, c, t, g, unknown or other
  modified_base (609)..(609): a, c, t, g, unknown or other
  modified_base (626)..(626): a, c, t, g, unknown or other
  modified_base (659)..(659): a, c, t, g, unknown or other
  modified_base (670)..(670): a, c, t, g, unknown or other
  modified_base (672)..(672): a, c, t, g, unknown or other
  modified_base (694)..(694): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
atggaccaaggngaagtaaattttgtgtttgnagtacctttaattctttctgtccatccnaaatattctaaccccnaancccatgccatgagtggnttttagggaaagaattaagacnatgttgtaaaatcttgtaagttgcagtttgcagnattagtattggaccaacaatgtcctcccactcaagtggcataacrgtagaaaacactgttactagntagaaanagaatstnaggggagaancnatagtctaaactacagaacccagrttaaaatagaaaaantctgtactnttccnnnnnnnnnnnnnnnnnnnnnnnnnnnnnnnnnnnnnnctgnaaataaacagtattataaantggtatatttaaacaaataaatatctanctacaangtaattctttttnatctaatcttgaaccagtggttctggctccntcttakcttgtcataatctttgtaactcatcttgaatgcttttttggagttgcacctgttccttggtttatatatgctccagggatttcttgtcagctggccntaagacatgatttggcaatttgtcattccattnactgnattcatttagctgntaaaattgacacttanggatastttagtttcangaatccttcttataacagtgggctttcacaatntccttcctatncntgcagaaataatcctccacaancnaagcacaaaagaaaaatnagnttggt

SEQ ID NO: 4884 - DNA, 200 bp, Artificial Sequence
  Description of Artificial Sequence: Synthetic polynucleotide
  modified_base (17)..(17): a, c, t, g, unknown or other
  modified_base (31)..(31): a, c, t, g, unknown or other
  modified_base (93)..(93): a, c, t, g, unknown or other
  modified_base (98)..(98): a, c, t, g, unknown or other
  modified_base (102)..(102): a, c, t, g, unknown or other
  modified_base (112)..(112): a, c, t, g, unknown or other
  modified_base (114)..(114): a, c, t, g, unknown or other
  modified_base (116)..(116): a, c, t, g, unknown or other
atgcatatcacaaagtntgtggaaaaaaaantgtttcccttccttatcctttgggtcttctcyttsaattaacctctgtttcaaaatactggnagctnaatntgaataaaanananaaagtttgccaaactagaactcmggtcagtgttcaggaaccaaaatcttgctttattgatacctacagaaaattccygggwtat

SEQ ID NO: 4885 - DNA, 861 bp, Artificial Sequence
  Description of Artificial Sequence: Synthetic polynucleotide
  modified_base (5)..(5): a, c, t, g, unknown or other
  modified_base (38)..(38): a, c, t, g, unknown or other
  modified_base (88)..(88): a, c, t, g, unknown or other
  modified_base (108)..(108): a, c, t, g, unknown or other
  modified_base (138)..(138): a, c, t, g, unknown or other
  modified_base (157)..(157): a, c, t, g, unknown or other
  modified_base (168)..(168): a, c, t, g, unknown or other
  modified_base (236)..(236): a, c, t, g, unknown or other
  modified_base (275)..(275): a, c, t, g, unknown or other
  modified_base (305)..(305): a, c, t, g, unknown or other
  modified_base (336)..(336): a, c, t, g, unknown or other
  modified_base (432)..(432): a, c, t, g, unknown or other
  misc_feature (442)..(446): This region may encompass 'gagtt' or is absent in its entirety
  modified_base (504)..(504): a, c, t, g, unknown or other
  modified_base (515)..(515): a, c, t, g, unknown or other
  modified_base (518)..(518): a, c, t, g, unknown or other
  modified_base (537)..(537): a, c, t, g, unknown or other
  modified_base (544)..(544): a, c, t, g, unknown or other
  modified_base (551)..(551): a, c, t, g, unknown or other
  modified_base (574)..(574): a, c, t, g, unknown or other
  modified_base (613)..(613): a, c, t, g, unknown or other
  modified_base (664)..(664): a, c, t, g, unknown or other
  modified_base (759)..(759): a, c, t, g, unknown or other
  modified_base (764)..(764): a, c, t, g, unknown or other
  modified_base (771)..(771): a, c, t, g, unknown or other
  modified_base (791)..(791): a, c, t, g, unknown or other
  modified_base (812)..(812): a, c, t, g, unknown or other
  modified_base (817)..(817): a, c, t, g, unknown or other
  modified_base (823)..(823): a, c, t, g, unknown or other
  modified_base (825)..(825): a, c, t, g, unknown or other
  modified_base (829)..(829): a, c, t, g, unknown or other
  modified_base (854)..(854): a, c, t, g, unknown or other
tttcngctttattatttccttgatatccacagcagaanttcagaggtataacttcaacattaacaggtgaaaagttctacaatgactngttgcactcyatcacattanaataattgaactataatttccatacaacanaagaaaactacagtatttngkgacaactgnaagatacctgataaataaatatatcaacttactaytcatgaaaagaatggagctggttatttcagctntaaaagggcaaagcaaaaagaccattttctagccatttnaaagttactcaaaaaattgatacaatggantggaaaggaaaacaaaaaagatygtaagcanctttaacaatgttcttgcattctactgatayacaaacctctrgggtttcagttgrcacaatcaagttcaacttgtactracagaaaatattaaaancttcctattgagtttttaatatcaaacagggaggttagtaaattgttttctgattcttctamaaaaaaaaangtctagaagangangggamtgtagtgtgcaccncttattnctaagtnataatttttacttacgaggtcanacgagtgcaaagggcttagtgatgcatcttattctttanttttggacagtaacaccctcagatggtatttttattggtttgttttatatnccccttttccatttgcccttctgttttgaagtgctttttcttaaaacttaagttctttgcctccattttcttataaacccaatttcctctttagntgcanctctacnatttgaaaggaacctttctnttgtaatttacaagctgtgantaacngctatntnattntttccaaggattaataaactgaganatgattt

SEQ ID NO: 4886 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (1959)..(1959): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacargagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtntgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4887 - DNA, 631 bp, Artificial Sequence
  Description of Artificial Sequence: Synthetic polynucleotide
  modified_base (37)..(37): a, c, t, g, unknown or other
  modified_base (58)..(58): a, c, t, g, unknown or other
  modified_base (61)..(61): a, c, t, g, unknown or other
  modified_base (89)..(89): a, c, t, g, unknown or other
  modified_base (102)..(102): a, c, t, g, unknown or other
  modified_base (134)..(134): a, c, t, g, unknown or other
  modified_base (138)..(138): a, c, t, g, unknown or other
  modified_base (144)..(144): a, c, t, g, unknown or other
  modified_base (148)..(148): a, c, t, g, unknown or other
  modified_base (171)..(171): a, c, t, g, unknown or other
  modified_base (177)..(177): a, c, t, g, unknown or other
  modified_base (191)..(191): a, c, t, g, unknown or other
  modified_base (201)..(201): a, c, t, g, unknown or other
  modified_base (205)..(205): a, c, t, g, unknown or other
  modified_base (215)..(215): a, c, t, g, unknown or other
  modified_base (231)..(231): a, c, t, g, unknown or other
  modified_base (256)..(256): a, c, t, g, unknown or other
  modified_base (295)..(295): a, c, t, g, unknown or other
  modified_base (319)..(319): a, c, t, g, unknown or other
  modified_base (327)..(327): a, c, t, g, unknown or other
  modified_base (353)..(353): a, c, t, g, unknown or other
  modified_base (356)..(356): a, c, t, g, unknown or other
  modified_base (392)..(392): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (447)..(447): a, c, t, g, unknown or other
  modified_base (454)..(454): a, c, t, g, unknown or other
  modified_base (480)..(480): a, c, t, g, unknown or other
  modified_base (486)..(486): a, c, t, g, unknown or other
  modified_base (529)..(529): a, c, t, g, unknown or other
  modified_base (546)..(546): a, c, t, g, unknown or other
  modified_base (554)..(554): a, c, t, g, unknown or other
  modified_base (570)..(570): a, c, t, g, unknown or other
  modified_base (575)..(575): a, c, t, g, unknown or other
  modified_base (590)..(590): a, c, t, g, unknown or other
  modified_base (617)..(617): a, c, t, g, unknown or other
  modified_base (620)..(620): a, c, t, g, unknown or other
ctgaaacagcaattgggaggcccattttactggccantatataattmcattagtaagnagnctagcaaagaataatcatatcaatttcntaatcagctgcanccatgctgaatttgaactggcaaactctgatntgtnagttgntagntgtgatcttcatatcactaaaangaacangataccattctaanaactttacanaganatagtctagnagacattgttctgccntggtcacagtaacaaaaaagtggtnaaaatcagttactttataaatactgataatttgcagcantaaggaacaggacattaaaaaaantaaatttncccataggacacctatgactaggaantcnttcctaagagaagccaaagttttaattattcagttncacaactantgtactgggttacntantctaagaaagaaaaggtgctctacagagntttcccncacacacaaagaatcagcrttaattnagcatnatctctrtcattcacagatctggcagattcattaactcatttnaaatgaataaggccaanaggatgcnggaaggtgtggctgantgagntccagggctgtatcncagcttattgatggcaccccattaggnaantgaatacraag

SEQ ID NO: 4888 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (899)..(899): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattaytccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacnatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4889 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1456)..(1456): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcanttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatwtcacatactatcaaactcttcctcactgtcatcagtctactgcaytgaatcaacataacaaagctaantgactcctgagggcngaatcagaaagaagaaaagaaagagayacnaaaantt

SEQ ID NO: 4890 - DNA, 460 bp, Artificial Sequence
  Description of Artificial Sequence: Synthetic polynucleotide
  modified_base (25)..(25): a, c, t, g, unknown or other
  modified_base (30)..(30): a, c, t, g, unknown or other
  modified_base (37)..(37): a, c, t, g, unknown or other
  modified_base (57)..(57): a, c, t, g, unknown or other
  modified_base (69)..(69): a, c, t, g, unknown or other
  modified_base (72)..(72): a, c, t, g, unknown or other
  modified_base (113)..(113): a, c, t, g, unknown or other
  modified_base (117)..(117): a, c, t, g, unknown or other
  modified_base (146)..(146): a, c, t, g, unknown or other
  modified_base (157)..(157): a, c, t, g, unknown or other
  modified_base (167)..(167): a, c, t, g, unknown or other
  modified_base (174)..(174): a, c, t, g, unknown or other
  modified_base (191)..(191): a, c, t, g, unknown or other
  modified_base (201)..(201): a, c, t, g, unknown or other
  modified_base (212)..(212): a, c, t, g, unknown or other
  modified_base (225)..(225): a, c, t, g, unknown or other
  modified_base (231)..(231): a, c, t, g, unknown or other
  modified_base (243)..(243): a, c, t, g, unknown or other
  modified_base (284)..(284): a, c, t, g, unknown or other
  modified_base (297)..(297): a, c, t, g, unknown or other
  modified_base (300)..(300): a, c, t, g, unknown or other
  modified_base (302)..(302): a, c, t, g, unknown or other
  modified_base (305)..(305): a, c, t, g, unknown or other
  modified_base (308)..(308): a, c, t, g, unknown or other
  modified_base (313)..(313): a, c, t, g, unknown or other
  modified_base (318)..(318): a, c, t, g, unknown or other
  modified_base (330)..(330): a, c, t, g, unknown or other
  modified_base (336)..(336): a, c, t, g, unknown or other
  modified_base (342)..(342): a, c, t, g, unknown or other
  modified_base (347)..(347): a, c, t, g, unknown or other
  modified_base (371)..(371): a, c, t, g, unknown or other
  modified_base (414)..(414): a, c, t, g, unknown or other
  modified_base (420)..(420): a, c, t, g, unknown or other
  modified_base (422)..(422): a, c, t, g, unknown or other
  modified_base (443)..(443): a, c, t, g, unknown or other
  modified_base (453)..(453): a, c, t, g, unknown or other
tccttcactttgaagrtgtcagctnccagnacataangacaaagagaaaacctcagngtcatgtttaancantctgatttatactgaggacaaattaaagaaagtaatttatntaangaagagtaaacttatggaactcattgccnaaagaggaggnacagacrtanaaatatncaaagacatctacgagnaattgttcanacmtttattgnacagcagcctaanagaacntggagcacgatnaygtttggagtcaccctgaggttsacatcacagcacacaanagctttttgcccnacngncantgngcccnagtgntttctgaggacnggaatngggagntgganggacctgcaggtcctccccatggnacaaacgctgcaccttgcacacacctgggtccctgcyatgtcnagcccnancctgtgcacagtgaggagagnacacctggtnatcagga

SEQ ID NO: 4891 - DNA, 249 bp, Artificial Sequence
  Description of Artificial Sequence: Synthetic polynucleotide
  modified_base (38)..(38): a, c, t, g, unknown or other
  modified_base (41)..(41): a, c, t, g, unknown or other
  modified_base (59)..(59): a, c, t, g, unknown or other
  modified_base (65)..(65): a, c, t, g, unknown or other
  modified_base (71)..(71): a, c, t, g, unknown or other
  modified_base (73)..(73): a, c, t, g, unknown or other
  modified_base (78)..(78): a, c, t, g, unknown or other
  modified_base (91)..(91): a, c, t, g, unknown or other
  modified_base (103)..(103): a, c, t, g, unknown or other
  modified_base (194)..(194): a, c, t, g, unknown or other
  modified_base (211)..(211): a, c, t, g, unknown or other
  modified_base (241)..(241): a, c, t, g, unknown or other
ctttgatggtcctgtcaccagaggcagacacratgtanttntcgtcaaagtctactacnttgacngcagcncngtggncaaccaggacacncgtaaagtgatntcggtcgcagaagccatgtcccacacagcaatggagcggtccttggaacaggtcaccatcagtccaytgytgaagcgtaagtgcartacancctcattgtggtggatnaatgtgttaagaacttcacccgtgttcacntcccacac

SEQ ID NO: 4892 - DNA, 673 bp, Artificial Sequence
  Description of Artificial Sequence: Synthetic polynucleotide
  modified_base (14)..(14): a, c, t, g, unknown or other
  modified_base (78)..(78): a, c, t, g, unknown or other
  modified_base (87)..(87): a, c, t, g, unknown or other
  modified_base (110)..(110): a, c, t, g, unknown or other
  modified_base (134)..(134): a, c, t, g, unknown or other
  modified_base (139)..(139): a, c, t, g, unknown or other
  modified_base (164)..(164): a, c, t, g, unknown or other
  modified_base (180)..(180): a, c, t, g, unknown or other
  modified_base (277)..(277): a, c, t, g, unknown or other
  modified_base (285)..(285): a, c, t, g, unknown or other
  modified_base (297)..(297): a, c, t, g, unknown or other
  modified_base (360)..(360): a, c, t, g, unknown or other
  modified_base (370)..(370): a, c, t, g, unknown or other
  modified_base (442)..(442): a, c, t, g, unknown or other
  modified_base (615)..(615): a, c, t, g, unknown or other
  modified_base (672)..(672): a, c, t, g, unknown or other
cgcgactatgctgnctccttcccatccagcaaagctcctgcttcaggccctcagatggactgaccacagtagcaccgncccatcctnctggacccaggatgcacctgccngagcgcctgagtgccctgagccantgcangggstctcccagggctcaccaggcngcactttccttgyagngctccctgtggattgccatggctgctaggagagcttygyggaggagacgctgacggagaccaactgcaggaacactgtggacttgttgaggaggctngggrctgnccctcggcrccngcatggtgctgggacgcaggaggctcggggctgcccccttggtgcatgmacrgtgctgggacnctgtcagacnctcctgtctttgccccgaagcagaggccaagagaggcacaagggccgcacacctgcctgctcctcttggacncgggtgcccgagcataccctgcaagtgtgcagtctgtcctccaggctgatgcctgmaacacagaccctgtcctgtgccacacccagggctggtctctgaggacctctgtgcagagcyggtgttggccccaggtcccttccctcccagtccaggagctgtagcttgttggcagngggctccatatgcctgagaccaacctgccccctgcacatggatgttgggctgtcacng

SEQ ID NO: 4893 - DNA, 529 bp, Artificial Sequence
  Description of Artificial Sequence: Synthetic polynucleotide
  modified_base (27)..(27): a, c, t, g, unknown or other
  modified_base (30)..(30): a, c, t, g, unknown or other
  modified_base (43)..(43): a, c, t, g, unknown or other
  modified_base (84)..(84): a, c, t, g, unknown or other
  modified_base (135)..(135): a, c, t, g, unknown or other
  modified_base (151)..(151): a, c, t, g, unknown or other
  modified_base (162)..(162): a, c, t, g, unknown or other
  modified_base (166)..(166): a, c, t, g, unknown or other
  modified_base (217)..(217): a, c, t, g, unknown or other
  modified_base (322)..(322): a, c, t, g, unknown or other
  modified_base (363)..(363): a, c, t, g, unknown or other
  modified_base (404)..(404): a, c, t, g, unknown or other
  modified_base (406)..(406): a, c, t, g, unknown or other
  modified_base (444)..(444): a, c, t, g, unknown or other
  modified_base (454)..(454): a, c, t, g, unknown or other
caacctgagtttcttaaaacctcatangcntcatggattcaanaaaataagtcatgattatgataataatttttagaggttccngtaaggtagaaactgctgttatttcaacttcccaaaatgccttgtggggcnctaaggctatctgtanaatctagaaanaganatatattcaaattagctatgtcacatcaaaatttggagaagaagtaaaaanaaagaaatttaagagatttactccaccaatctcttggtaatttttgtgttcattatcartaagctgtgtgcatccttttagagtgctactgtttgagaaaagcancattgaagttgctgctgatcttggtcatgcattttcagagngtgcttatcagcagacttggatgctgttggggttctstttntnatttgcaatttttccaagacaggctttctgttgcccangctggagtgngtagctgctgtttctcaatagacaagtcctagaagtagarataattcaattttcattcactcttagctcttctgc

SEQ ID NO: 4894 - DNA, 1247 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  modified_base (1207)..(1207): a, c, t, g, unknown or other
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctytcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcanaatttcatataccttctcttctgttahgtaagtcacatct

SEQ ID NO: 4895 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1551)..(1551): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggngccggtcctgggcagcctcccttgctnaggccacnctgctcccaagaagccaggatgagcagctcgcaataggcccccnaacacgcagagtgccangcrgaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4896 - DNA, 943 bp, Artificial Sequence
  Description of Artificial Sequence: Synthetic polynucleotide
  modified_base (9)..(9): a, c, t, g, unknown or other
  modified_base (15)..(15): a, c, t, g, unknown or other
  modified_base (41)..(41): a, c, t, g, unknown or other
  modified_base (56)..(56): a, c, t, g, unknown or other
  modified_base (63)..(63): a, c, t, g, unknown or other
  modified_base (108)..(108): a, c, t, g, unknown or other
  modified_base (138)..(138): a, c, t, g, unknown or other
  modified_base (179)..(179): a, c, t, g, unknown or other
  modified_base (188)..(188): a, c, t, g, unknown or other
  modified_base (245)..(245): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (411)..(411): a, c, t, g, unknown or other
  modified_base (466)..(466): a, c, t, g, unknown or other
  modified_base (491)..(491): a, c, t, g, unknown or other
  modified_base (506)..(506): a, c, t, g, unknown or other
  modified_base (512)..(512): a, c, t, g, unknown or other
  modified_base (524)..(524): a, c, t, g, unknown or other
  modified_base (613)..(613): a, c, t, g, unknown or other
  modified_base (710)..(710): a, c, t, g, unknown or other
  modified_base (758)..(758): a, c, t, g, unknown or other
  modified_base (838)..(838): a, c, t, g, unknown or other
  modified_base (876)..(876): a, c, t, g, unknown or other
  modified_base (882)..(882): a, c, t, g, unknown or other
  modified_base (903)..(903): a, c, t, g, unknown or other
  modified_base (912)..(912): a, c, t, g, unknown or other
  modified_base (916)..(916): a, c, t, g, unknown or other
  modified_base (930)..(930): a, c, t, g, unknown or other
  modified_base (932)..(932): a, c, t, g, unknown or other
  modified_base (936)..(936): a, c, t, g, unknown or other
tttcaaaanacgaancttgtcataattattaagaattatanttgaaaacctaaaanctttctntaaacactcttctgcccccaaagattgggcccctgtcctacagcnttatctctgttgagatttttgactataatnactttcagatactatgattttaaattcaagaggaggggaanagaaamaancagggaaagcaagaagagctgagagaggaatctcygaatgaaatctgggggataaanagawgtcaacaggaagatgggtcagttrgcctccaattattattcagttcarcctctccataaaaagtcacngttttatctcytcagctacrtgnaaagatcttggaggacaagtactcttccttcaagntcttttaatccttcccaagaaactgagngcagatanaaggtatcgaataaatgtttactgaatattttatctaatttttaccaaaatatgnaggtacatagtcctatttatgtcangtaactctaagatantracgnttatttcttatnaaactaaataataaaaacagactgatcatggcagttgggcataattcttgctggttacaacaaaaattctcagcctgtaaatgaagatnctggtaacatccccaaattatcatgctcattagaatcatgggggtgcaagcggaaatcacagaaaagactggagaaatgaccaagagatgaaatacnataggaaaakataacccccttacaaatttgtaaatgccacatatttcnttttggaattatgctgaccaggatctactcaaggtggcttttagagagatgcagatgtacattaaaataatagtagaaantgtccttcctggaatggaaattcaaacacatgactganttttgnctcaactctaattcttctacntctgtagtnagangtttaaatcctatnanatcncctcccc

SEQ ID NO: 4897 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcmtacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4898 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (569)..(569): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgncctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagrctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4899 - DNA, 1485 bp, Artificial Sequence
  Description of Artificial Sequence: Synthetic polynucleotide
  misc_feature (66)..(67): This region may encompass 'ct' or is absent in its entirety
  modified_base (134)..(134): a, c, t, g, unknown or other
  modified_base (143)..(143): a, c, t, g, unknown or other
  modified_base (215)..(215): a, c, t, g, unknown or other
  modified_base (268)..(268): a, c, t, g, unknown or other
  modified_base (330)..(330): a, c, t, g, unknown or other
  modified_base (354)..(354): a, c, t, g, unknown or other
  modified_base (417)..(417): a, c, t, g, unknown or other
  modified_base (638)..(638): a, c, t, g, unknown or other
  modified_base (647)..(647): a, c, t, g, unknown or other
  modified_base (685)..(685): a, c, t, g, unknown or other
  modified_base (704)..(704): a, c, t, g, unknown or other
  modified_base (723)..(723): a, c, t, g, unknown or other
  modified_base (888)..(888): a, c, t, g, unknown or other
  modified_base (936)..(936): a, c, t, g, unknown or other
  modified_base (985)..(985): a, c, t, g, unknown or other
  modified_base (1023)..(1023): a, c, t, g, unknown or other
  modified_base (1053)..(1053): a, c, t, g, unknown or other
  modified_base (1128)..(1128): a, c, t, g, unknown or other
  modified_base (1204)..(1204): a, c, t, g, unknown or other
  modified_base (1300)..(1300): a, c, t, g, unknown or other
  modified_base (1344)..(1344): a, c, t, g, unknown or other
  modified_base (1367)..(1367): a, c, t, g, unknown or other
  modified_base (1377)..(1377): a, c, t, g, unknown or other
  modified_base (1477)..(1477): a, c, t, g, unknown or other
  modified_base (1483)..(1483): a, c, t, g, unknown or other
attttagtatatasgttctaatatttggggtattcctagaaatgtgtacctattattcacttgctctatatatatagcaaagtgaattttatatataattcttcaacatatttttagaaaaattaagttttttntagaaaatnaagagaattttagataaaaactcaacttttaatggaaaatattktcctttttctttctcacatgaaatyctntatcaaggttagtatcctacctggyatctctccaatastgggttaagagtttnttcttctcaagtaacctgtattatattaagatgatattaactgaaataatcagatagatgantgcrycataaagctaattctaagntatctgtccttagccaaaagcagaaaagggatacacataactyccacataaaacatccacccncatttttttggttattcttaaaagctcataatgtatacaatgataaaatttattgtttcaaattagggtttttgaaattgaaatattaatttaaacacgtttgcttaacacaactttaaagttaataagaaaacactgchtattacagaagagttaaatacttcaaaaagtgggaaaraatttaaaagctttcatttkagtaggagtaaacacagacacantaagaatcntagttggatacactkaaatcatgtcttttaagaacatnagaacagattatttgcttnctctttagtccaaaacctnggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaagntgagtcaataaggtgaaccagattctggttgaatggaatccttgaaanataactttggtgaacaaactgtttgtgttttccacttttcttaaaaaangaagtgataaagcagatttccagtacctgccarctganaaaatgytacttaccaggtaaaaaccaytnccaaaaatcagaatcacagaagggctatcagtaaaaytaytaatgccacaaattaacatgatgttaacwgctganttatgcatcaaaagagtatttatataatcacagcaaataactcaaatcttttacatcactagtaaactcaaaaaanatagmaaaaagcaataacattaaatttcmttattgatctactagctttaactatttaatactagtacacttagttttgattactttgaaattgaancaaaaacaataatcttttcttcttttaatgactttttcagttanaggaaagatgatattaaaagaanatatacaacnatagcttagctacaggtataaaaytgttttaaagatatgtaattgtgctattgaattaaactgaaaacataaatatcaactcatgattttgaaaaaaaantctttnat

SEQ ID NO: 4900 - DNA, 919 bp, Artificial Sequence
  Description of Artificial Sequence: Synthetic polynucleotide
  misc_feature (184)..(184): May or may not be present
  modified_base (195)..(195): a, c, t, g, unknown or other
  modified_base (256)..(256): a, c, t, g, unknown or other
  modified_base (276)..(276): a, c, t, g, unknown or other
  modified_base (316)..(316): a, c, t, g, unknown or other
  modified_base (623)..(623): a, c, t, g, unknown or other
  modified_base (679)..(679): a, c, t, g, unknown or other
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaaatgacccctggnagagccaggcgcagcacagacagaaagccctgcctgaaagtgactggagccaagagcctgncactctcggctcattccgtncagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggnctccttggaaccrgctggacatggcggtgacgggacctagtctgcgagtcgagtcntgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4901 - DNA, 276 bp, Artificial Sequence
  Description of Artificial Sequence: Synthetic polynucleotide
  modified_base (95)..(95): a, c, t, g, unknown or other
  modified_base (132)..(132): a, c, t, g, unknown or other
tctacatttcactatgtgctggtaaattcactccatcaaatcatcaccaatgtaagtccaataggcattgctaaactactaaaaaaaaaaatttncattattttctttgcatatttctttttacgaaacgcnctcttggttttcaaaaaggttctgaatttagatgtacggaataggaaaatttctccayggtgattatatttgataattgataaatacttgtatttttcatagtaagccttgaccgaagggcccatattaaggaagatggagtta

SEQ ID NO: 4902 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcmgttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4903 - DNA, 322 bp, Artificial Sequence
  Description of Artificial Sequence: Synthetic polynucleotide
  modified_base (58)..(58): a, c, t, g, unknown or other
  modified_base (64)..(64): a, c, t, g, unknown or other
  modified_base (66)..(66): a, c, t, g, unknown or other
  modified_base (86)..(86): a, c, t, g, unknown or other
  modified_base (115)..(115): a, c, t, g, unknown or other
  modified_base (129)..(129): a, c, t, g, unknown or other
  modified_base (145)..(145): a, c, t, g, unknown or other
  modified_base (147)..(147): a, c, t, g, unknown or other
  modified_base (155)..(155): a, c, t, g, unknown or other
  modified_base (179)..(179): a, c, t, g, unknown or other
  modified_base (241)..(241): a, c, t, g, unknown or other
  modified_base (265)..(265): a, c, t, g, unknown or other
  modified_base (270)..(270): a, c, t, g, unknown or other
  modified_base (282)..(282): a, c, t, g, unknown or other
tgactggcctctcttttacctatctggttttgaattacattggctaacttcagaaaantcatcntnactaaattgtctctgaaagntaattgaggcagaagatatatgcagtycntcagcaattgtttnagctgcactgtcagtntngaaataancagcctaataagaggtcagatacntggrktttaaaagcctatttatcatacagtattcaaamcctttaatcattttataagcctcncmttaaatgtcagttgtcattctntttcncatcatgattanttaacaaaccaaaataccattatgttgttccttttctaga

SEQ ID NO: 4904 - DNA, 505 bp, Artificial Sequence
  Description of Artificial Sequence: Synthetic polynucleotide
  modified_base (7)..(7): a, c, t, g, unknown or other
  modified_base (27)..(27): a, c, t, g, unknown or other
  modified_base (41)..(41): a, c, t, g, unknown or other
  modified_base (114)..(241): a, c, t, g, unknown or other
  modified_base (275)..(275): a, c, t, g, unknown or other
  modified_base (306)..(306): a, c, t, g, unknown or other
  modified_base (312)..(312): a, c, t, g, unknown or other
  modified_base (321)..(321): a, c, t, g, unknown or other
  modified_base (336)..(336): a, c, t, g, unknown or other
  modified_base (360)..(360): a, c, t, g, unknown or other
ccaagcnctggatgttaagaacagaanraagatacaggtangagcttttggccttcaacatgtgtaagtacacrgacaaatacagatgtaaatgtgtgcatgcacacgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttattgcaccatctacatggatgctttctggngtctttctgttagcttgaaattgcttcaaantgtaantgattttanaacaaaaattttaangaattacagtattatttatctctnctacatcaagcttttctcttgtagtctatcttacaggtacttccayatgaatataaacagatctatyactttgtgtttactggcaacatggatggaatttccagaatggaacagtaggttaattatcttttttataaggcagcaa

SEQ ID NO: 4905 - DNA, 272 bp, Artificial Sequence
  Description of Artificial Sequence: Synthetic polynucleotide
  modified_base (8)..(8): a, c, t, g, unknown or other
  modified_base (19)..(19): a, c, t, g, unknown or other
  modified_base (22)..(22): a, c, t, g, unknown or other
  modified_base (33)..(33): a, c, t, g, unknown or other
  modified_base (59)..(59): a, c, t, g, unknown or other
  modified_base (70)..(70): a, c, t, g, unknown or other
  modified_base (72)..(72): a, c, t, g, unknown or other
  modified_base (112)..(112): a, c, t, g, unknown or other
  modified_base (126)..(126): a, c, t, g, unknown or other
  modified_base (130)..(130): a, c, t, g, unknown or other
  modified_base (136)..(136): a, c, t, g, unknown or other
  modified_base (138)..(138): a, c, t, g, unknown or other
  modified_base (145)..(145): a, c, t, g, unknown or other
  modified_base (148)..(148): a, c, t, g, unknown or other
  modified_base (170)..(170): a, c, t, g, unknown or other
  modified_base (175)..(175): a, c, t, g, unknown or other
  modified_base (218)..(218): a, c, t, g, unknown or other
  modified_base (222)..(222): a, c, t, g, unknown or other
  modified_base (234)..(234): a, c, t, g, unknown or other
  modified_base (251)..(251): a, c, t, g, unknown or other
  modified_base (254)..(254): a, c, t, g, unknown or other
  modified_base (268)..(268): a, c, t, g, unknown or other
grctyaanggtaaaatcanttnatgtattttgnttggaagtcattcttgaagtgaaaanacrttctgctntnctttwggtttcagcctctctttatgttaatgaatactaangaaaacaaaagtanccanctagtngnaaagcangcncttgttaatcacrtcactacanaaatnaaataaggctatttacacaattgcaaagaatctctttacattnattnactgttttccanagcagctcatgtaaganagntgttaacagattanattt

SEQ ID NO: 4906 - DNA, 225 bp, Artificial Sequence
  Description of Artificial Sequence: Synthetic polynucleotide
  modified_base (1)..(24): a, c, t, g, unknown or other
  modified_base (26)..(26): a, c, t, g, unknown or other
  modified_base (95)..(95): a, c, t, g, unknown or other
  modified_base (112)..(112): a, c, t, g, unknown or other
  modified_base (118)..(118): a, c, t, g, unknown or other
nnnnnnnnnnnnnnnnnnnnnnnnangccagggagccttaaaaggtagttctctaagttaccaaaatcrtattgttctccrgaatatatcattanaactaaaacagtgttgnacatgnagacccatccaaattatgtttgcccatgagctccataaagaagccaaatatgtgtgactctgttgccctgcaacaggcatctcctgactcctctggctggtcatctc

SEQ ID NO: 4907 - DNA, 93 bp, Artificial Sequence
  Description of Artificial Sequence: Synthetic oligonucleotide
  modified_base (30)..(30): a, c, t, g, unknown or other
taaaaaagatttcattatgtcagtgaaacntggtggacgaatgtcaaaaattttaaaatatcartatactaatatttaagttatagtcaatat

SEQ ID NO: 4908 - DNA, 541 bp, Artificial Sequence
  Description of Artificial Sequence: Synthetic polynucleotide
  modified_base (57)..(57): a, c, t, g, unknown or other
  modified_base (174)..(174): a, c, t, g, unknown or other
  modified_base (251)..(251): a, c, t, g, unknown or other
gtggtaaaaatccagtgccctaaacccatatccagagctgtgagagtttttcactgnctaatttacagttttcttgcatcagagaaaaaataaggctcagaaactaggtattcgatttgcccaaaactctcatcagatagaaaatccattccctaactttctagctagtattanttccataaagttagatcagtatcactccgaaaataaatacacgtcacccagtatatttctcccaaataaaagaggangcaaggcgytttacaacccagtgatgggctaccacatcaacacaggaaagaggtgccaagctcctttactcccgtccataaccctacacagaaaagagtgggtgcagtggaatgaggctgggtggagagaagttcctcttcttactgacaaaatagatcacagggcatcacgtaatatgtaaaagtctttataatacagcatattattttctttggaaaaccttttctaatattttggtatcagtaaaaaccctcagatgaatttcaaacactataaaaatacaatacat

SEQ ID NO: 4909 - DNA, 412 bp, Artificial Sequence
  Description of Artificial Sequence: Synthetic polynucleotide
  modified_base (85)..(85): a, c, t, g, unknown or other
  modified_base (137)..(137): a, c, t, g, unknown or other
  modified_base (185)..(185): a, c, t, g, unknown or other
  modified_base (268)..(268): a, c, t, g, unknown or other
  misc_feature (360)..(361): This region may encompass 'aa' or 'gt'
  modified_base (368)..(368): a, c, t, g, unknown or other
ggataggtaggatttacagactggaaaatgggaaaaagatgagagtggaaaaaggaaggaggggtagcamgaatggcgggcaggnrgacagaaargtaaaattcagccatgttcaaaagggaacaaataaaagcacngaaaggtaagacagacctagtatatttatgacttgaatcccaagctangaaactggaacataatttagcagagagactccaaaagttttacagcaaaaagtattagaatcatttatatactgggaaaaaantagcctcctcattttaataatccagattgggaaatcagatctaaaacagatgttcaatggacatcccatttcttttgtaaaagcaacttgarwggtcagncatcaagttttgttctgtttttaattcacaatgaaaatctgact

SEQ ID NO: 4910 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccaytatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4911 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  modified_base (351)..(351): a, c, t, g, unknown or other
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagatancatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccygcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4912 - DNA, 722 bp, Artificial Sequence
  Description of Artificial Sequence: Synthetic polynucleotide
  modified_base (12)..(12): a, c, t, g, unknown or other
  modified_base (32)..(32): a, c, t, g, unknown or other
  modified_base (60)..(60): a, c, t, g, unknown or other
  modified_base (76)..(76): a, c, t, g, unknown or other
  modified_base (79)..(79): a, c, t, g, unknown or other
  modified_base (96)..(96): a, c, t, g, unknown or other
  modified_base (118)..(118): a, c, t, g, unknown or other
  modified_base (152)..(152): a, c, t, g, unknown or other
  modified_base (218)..(218): a, c, t, g, unknown or other
  modified_base (225)..(225): a, c, t, g, unknown or other
  modified_base (233)..(233): a, c, t, g, unknown or other
  modified_base (243)..(243): a, c, t, g, unknown or other
  modified_base (245)..(245): a, c, t, g, unknown or other
  modified_base (284)..(284): a, c, t, g, unknown or other
  modified_base (293)..(293): a, c, t, g, unknown or other
  modified_base (298)..(335): a, c, t, g, unknown or other
  modified_base (339)..(339): a, c, t, g, unknown or other
  modified_base (359)..(359): a, c, t, g, unknown or other
  modified_base (387)..(387): a, c, t, g, unknown or other
  modified_base (394)..(394): a, c, t, g, unknown or other
  modified_base (407)..(407): a, c, t, g, unknown or other
  modified_base (444)..(444): a, c, t, g, unknown or other
  modified_base (541)..(541): a, c, t, g, unknown or other
  modified_base (574)..(574): a, c, t, g, unknown or other
  modified_base (579)..(579): a, c, t, g, unknown or other
  modified_base (593)..(593): a, c, t, g, unknown or other
  modified_base (609)..(609): a, c, t, g, unknown or other
  modified_base (626)..(626): a, c, t, g, unknown or other
  modified_base (659)..(659): a, c, t, g, unknown or other
  modified_base (670)..(670): a, c, t, g, unknown or other
  modified_base (672)..(672): a, c, t, g, unknown or other
  modified_base (694)..(694): a, c, t, g, unknown or other
  modified_base (696)..(696): a, c, t, g, unknown or other
  modified_base (714)..(714): a, c, t, g, unknown or other
  modified_base (717)..(717): a, c, t, g, unknown or other
atggaccaaggngaagtaaattttgtgtttgnagtacctttaattctttctgtccatccnaaatattctaaccccnaancccatgccatgagtggnttttagggaaagaattaagacnatgttgtaaaatcttgtaagttgcagtttgcagnattagtattggaccaacaatgtcctcccactcaagtggcataacrgtagaaaacactgttactagntagaaanagaatstnaggggagaancnatagtctaaactacagaacccagrttaaaatagaaaaantctgtactnttccnnnnnnnnnnnnnnnnnnnnnnnnnnnnnnnnnnnnnnctgnaaataaacagtattataaantggtatatttaaacaaataaatatctanctacaangtaattctttttnatctaatcttgaaccagtggttctggctccrtcttancttgtcataatctttgtaactcatcttgaatgcttttttggagttgcacctgttccttggtttatatatgctccagggatttcttgtcagctggccntaagacatgatttggcaatttgtcattccattnactgnattcatttagctgntaaaattgacacttanggatastttagtttcangaatccttcttataacagtgggctttcacaatntccttcctatncntgcagaaataatcctccacaancnaagcacaaaagaaaaatnagnttggt

SEQ ID NO: 4913 - DNA, 1885 bp, Artificial Sequence
  Description of Artificial Sequence: Synthetic polynucleotide
  modified_base (4)..(32): a, c, t, g, unknown or other
  modified_base (46)..(46): a, c, t, g, unknown or other
  modified_base (101)..(101): a, c, t, g, unknown or other
  modified_base (164)..(164): a, c, t, g, unknown or other
  modified_base (182)..(182): a, c, t, g, unknown or other
  modified_base (187)..(187): a, c, t, g, unknown or other
  modified_base (199)..(199): a, c, t, g, unknown or other
  modified_base (293)..(293): a, c, t, g, unknown or other
  modified_base (320)..(320): a, c, t, g, unknown or other
  modified_base (403)..(403): a, c, t, g, unknown or other
  modified_base (583)..(583): a, c, t, g, unknown or other
  modified_base (600)..(600): a, c, t, g, unknown or other
  modified_base (606)..(606): a, c, t, g, unknown or other
  modified_base (640)..(640): a, c, t, g, unknown or other
  modified_base (888)..(888): a, c, t, g, unknown or other
  modified_base (976)..(976): a, c, t, g, unknown or other
  modified_base (981)..(981): a, c, t, g, unknown or other
  modified_base (990)..(990): a, c, t, g, unknown or other
  modified_base (998)..(998): a, c, t, g, unknown or other
  modified_base (1069)..(1069): a, c, t, g, unknown or other
  modified_base (1130)..(1130): a, c, t, g, unknown or other
  modified_base (1276)..(1276): a, c, t, g, unknown or other
  modified_base (1305)..(1305): a, c, t, g, unknown or other
  modified_base (1322)..(1322): a, c, t, g, unknown or other
  modified_base (1333)..(1333): a, c, t, g, unknown or other
  modified_base (1381)..(1381): a, c, t, g, unknown or other
  modified_base (1388)..(1388): a, c, t, g, unknown or other
  modified_base (1393)..(1393): a, c, t, g, unknown or other
  modified_base (1431)..(1431): a, c, t, g, unknown or other
  modified_base (1441)..(1441): a, c, t, g, unknown or other
  modified_base (1505)..(1505): a, c, t, g, unknown or other
  modified_base (1525)..(1525): a, c, t, g, unknown or other
  modified_base (1551)..(1551): a, c, t, g, unknown or other
  modified_base (1571)..(1571): a, c, t, g, unknown or other
  modified_base (1621)..(1621): a, c, t, g, unknown or other
  modified_base (1625)..(1625): a, c, t, g, unknown or other
  modified_base (1628)..(1628): a, c, t, g, unknown or other
  modified_base (1718)..(1718): a, c, t, g, unknown or other
  modified_base (1765)..(1765): a, c, t, g, unknown or other
  modified_base (1833)..(1833): a, c, t, g, unknown or other
  modified_base (1848)..(1848): a, c, t, g, unknown or other
  modified_base (1878)..(1878): a, c, t, g, unknown or other
  modified_base (1883)..(1883): a, c, t, g, unknown or other
gacnnnnnnnnnnnnnnnnnnnnnnnnnnnnncagaaatactgcanagtccctatttacatctttctacagtggtttttaaaatgttttaagaataaaaancatgcaaactttatttgatttttctgaggaaataactttttggatttaatttcaatgaaaccntgataacatttccctccncarcnatcyctggcaangatccctcagattttaawgattatgtattattaccttttaatacaagtagaataacactcagggaatttacaacwtttgttattttcagtaaanacattggttgaagtttaaaagtctatncgtagtaaacttacatctttcaggagcttggtcaatgtgttctggacaaagcaggaagatgtgactgaaatcctgaaaggwgncggctcctgcagcacaaggataatgatacatctgggtacatttctcttcacagcatttgatagtggctccaargtgcttacaaaatgcacatcgctgaaaggggtaaaggagagaaatctctttataaaaccttgaaaaggaatattcaaatataagctgggaaggtataaaaaactctngtayatcacaagtaaancaaatngaacctgcaaaatattaaacaaaggattcrttanaaataataaaatctacattactcaatttwgygcttcgtgtgctaccaactcatccttccattcaaattagaaagttagaatttcattccttatattttcaaaaataaattktgaagcatttttkaaacaaaacctaaagatttttttttaaagcaaatagtaatatggttaaargggcaggtttctatattgaggattattataaagtttttaaatcccaccaaaactagtaataggaacatatattnatttatgagacatattactattttttaccctgcctaaaaataaatacaaaataaactcatcaattrtaagttaacagggacayaaatngttangactcacanaaaaaaanaactacatacttcaatgtagcaatcaacttcaaatttcttaacaaaagatggaaatgtgggsgaaaaaaanttagtcatctggtatctttcccatttcaacctgcctccattwtcttgcaagtggtaaaayncacagaaataagccccaaacaagaggggcagtctagggcaagtgaacacataagaagtcrgaagaaattatgtaaaatgttgcatttacttattcagttttcccttagaatgattcacaaactcttcctcattctcccaagtccantttgagcatcattttctttgaagagagtntgatgggccctgtactntacagtatganatctctctgtgggaaatgactatctaacataaatttttgtttacaccnttacatngtacntacttgcttatgccattacatgatcagtttatcttttnctcatcctantccaagatccttcarttgaggcaccatactatctttgtatccaaagcaccaaaaatgctgcttnaaacaggccctaatagawangtgttcctatacatataccaaaaagncttaacttttggtgatcttntttgtgagtgtggctcataaacagcttagctgagataactggagcctcangtancanagacagttggaccctgctaacattactgtggatatcttcacatgttactacactgactttatattctgctaattaaccagggactacagnagttaaaattataattgttttcaatgttttatgtgtaaatctgtatntcacatactatcaaactcttcctcactgtcatcagtctactgcaytgaatcaacataacaaagctaantgactcctgagggcngaatcagaaagaagaaaagaaagagayacnaaaantt

SEQ ID NO: 4914 - DNA, 421 bp, Artificial Sequence
  Description of Artificial Sequence: Synthetic polynucleotide
  modified_base (70)..(70): a, c, t, g, unknown or other
  modified_base (93)..(93): a, c, t, g, unknown or other
  modified_base (134)..(134): a, c, t, g, unknown or other
  modified_base (168)..(168): a, c, t, g, unknown or other
  modified_base (275)..(275): a, c, t, g, unknown or other
  modified_base (321)..(321): a, c, t, g, unknown or other
  modified_base (337)..(337): a, c, t, g, unknown or other
  modified_base (356)..(356): a, c, t, g, unknown or other
  modified_base (366)..(366): a, c, t, g, unknown or other
caccgaattccagcmtttctgctggtaacaaatgyattggcaggarggggccgtgtcaggaagtgcctkncagggtcaggaggtgcccgtccnccgggactgaccctgtcctcgtccttgtctgtagctcygantcagggcccaggtgcagctctctgatggacacanaacacagccagsctgaggcagccagagccaaggcytcgagaaagcctgtgagtagcagcagtgcaggcrgcacccagcctcctgcagaggcctagccttgcccagtntaaggcctgaggccagctggcccccctccttggggtcagtgggagnaggtggccaggacccngcatgctgctaggtctctngtracattgnggtttgatacagcagtgggactggagcagccacgtgcagatggggaggcccccag

SEQ ID NO: 4915 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1029)..(1029): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaagayattttaaanccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4916 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (369)..(369): a, c, t, g, unknown or other
  modified_base (406)..(406): a, c, t, g, unknown or other
  modified_base (448)..(448): a, c, t, g, unknown or other
  modified_base (510)..(510): a, c, t, g, unknown or other
  modified_base (530)..(530): a, c, t, g, unknown or other
  modified_base (579)..(579): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttrgtttacntatctgtgggaaaagcatttttagtagaatgcttgcncatcttcctacattcctgtaatcaaacagtatttatcatcanctatgttggtgactctcactttgacataggctgaaccagaaatcctaggaaaaactgatganagaaagctaaggggaagganaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4917 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtstcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4918 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (939)..(939): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattnttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgyagttccccattccatgttgaakctcaaanaaaggtcctctctcttacacntccagattcagagngtagcatgttatgctggacttgtcttttttaagtctctctttgctty

SEQ ID NO: 4919 - DNA, 611 bp, Artificial Sequence
  Description of Artificial Sequence: Synthetic polynucleotide
  misc_feature (44)..(45): This region may encompass 'tg' or 'ca'
  modified_base (161)..(161): a, c, t, g, unknown or other
  modified_base (228)..(228): a, c, t, g, unknown or other
  modified_base (320)..(320): a, c, t, g, unknown or other
  modified_base (351)..(351): a, c, t, g, unknown or other
  modified_base (357)..(357): a, c, t, g, unknown or other
  modified_base (497)..(527): a, c, t, g, unknown or other
  modified_base (544)..(544): a, c, t, g, unknown or other
  modified_base (593)..(593): a, c, t, g, unknown or other
  modified_base (603)..(603): a, c, t, g, unknown or other
tatttactttggtaccaattctagatatayatctgcatataccyrggtatttaacttcctggtctcatgttccttaaatagttaataagaaagagtaattatgaaccatgcagascaattaacaagcctaacttccaatattttcttcactctgaartaantatttccaacaktgtattatgtcagaagttctcrgttttgggggtgctgtatcttaatttttctgtnctctaktttcaacttcactgamataatacaagctctatcttccttacaaatttataaggaatcaaatgaaatgaaatatataaaagttgtcntctttctcccatcttcaaaaaacttcccccngcaytncatttcctgttarccctctctccttcaacagcctggtctgtagaaagagtccatacatggcctccctccactscctcatcttccattcaytccttgttccaaggycctcccaacaccactgaaacttttttcaatgcccnnnnnnnnnnnnnnnnnnnnnnnnnnnnnnngcaaattctgcccccancttttcattctttcagttgaaccactttttccaaaacactgtgcagatntaaaaaatangtagttaa

SEQ ID NO: 4920 - DNA, 218 bp, Artificial Sequence
  Description of Artificial Sequence: Synthetic polynucleotide
  modified_base (50)..(50): a, c, t, g, unknown or other
  modified_base (82)..(82): a, c, t, g, unknown or other
  modified_base (84)..(84): a, c, t, g, unknown or other
  modified_base (92)..(92): a, c, t, g, unknown or other
  modified_base (95)..(95): a, c, t, g, unknown or other
  modified_base (201)..(201): a, c, t, g, unknown or other
  modified_base (216)..(216): a, c, t, g, unknown or other
taacaatatgtttattataacatccagccaagaatacaaacacaaaatanctcttaatktaaggagaataagaaaacatcangngattcttngantactactacaaatacagccttcacctacagtaaaaattaagccaatttcaatcattttggtcatcatcccagtctttcttcccacttggaggcttgggcccaccanctggttttgccatgnat

SEQ ID NO: 4921 - DNA, 142 bp, Artificial Sequence
  Description of Artificial Sequence: Synthetic polynucleotide
  modified_base (31)..(31): a, c, t, g, unknown or other
  modified_base (39)..(39): a, c, t, g, unknown or other
  modified_base (50)..(50): a, c, t, g, unknown or other
  misc_feature (80)..(81): This region may encompass 'ac' or 'gt'
  modified_base (115)..(115): a, c, t, g, unknown or other
  modified_base (125)..(125): a, c, t, g, unknown or other
acctttctgtgtctgggccatttttggctanaatcatcntarttttcctngtcctcccacaggtgctctgtctgtgcccrytgtaaactgcaagaagagtcttttctgttcatcntaaatgaatngatttcccagaactccc

SEQ ID NO: 4922 - DNA, 1141 bp, Artificial Sequence
  Description of Artificial Sequence: Synthetic polynucleotide
  modified_base (10)..(10): a, c, t, g, unknown or other
  modified_base (14)..(14): a, c, t, g, unknown or other
  modified_base (24)..(24): a, c, t, g, unknown or other
  modified_base (38)..(38): a, c, t, g, unknown or other
  modified_base (90)..(90): a, c, t, g, unknown or other
  modified_base (108)..(108): a, c, t, g, unknown or other
  modified_base (120)..(120): a, c, t, g, unknown or other
  modified_base (126)..(126): a, c, t, g, unknown or other
  modified_base (131)..(131): a, c, t, g, unknown or other
  modified_base (141)..(141): a, c, t, g, unknown or other
  modified_base (194)..(194): a, c, t, g, unknown or other
  modified_base (211)..(211): a, c, t, g, unknown or other
  modified_base (231)..(231): a, c, t, g, unknown or other
  modified_base (254)..(254): a, c, t, g, unknown or other
  modified_base (287)..(287): a, c, t, g, unknown or other
  modified_base (294)..(294): a, c, t, g, unknown or other
  modified_base (301)..(301): a, c, t, g, unknown or other
  modified_base (303)..(303): a, c, t, g, unknown or other
  modified_base (312)..(312): a, c, t, g, unknown or other
  modified_base (316)..(316): a, c, t, g, unknown or other
  modified_base (331)..(331): a, c, t, g, unknown or other
  modified_base (356)..(356): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
  modified_base (394)..(394): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (443)..(443): a, c, t, g, unknown or other
  modified_base (458)..(458): a, c, t, g, unknown or other
  modified_base (476)..(476): a, c, t, g, unknown or other
  modified_base (488)..(488): a, c, t, g, unknown or other
  modified_base (498)..(498): a, c, t, g, unknown or other
  modified_base (512)..(512): a, c, t, g, unknown or other
  modified_base (525)..(525): a, c, t, g, unknown or other
  modified_base (534)..(534): a, c, t, g, unknown or other
  modified_base (536)..(536): a, c, t, g, unknown or other
  modified_base (569)..(569): a, c, t, g, unknown or other
  modified_base (640)..(640): a, c, t, g, unknown or other
  modified_base (654)..(654): a, c, t, g, unknown or other
  modified_base (656)..(656): a, c, t, g, unknown or other
  modified_base (667)..(667): a, c, t, g, unknown or other
  modified_base (669)..(669): a, c, t, g, unknown or other
  modified_base (676)..(676): a, c, t, g, unknown or other
  modified_base (719)..(756): a, c, t, g, unknown or other
  modified_base (758)..(822): a, c, t, g, unknown or other
  modified_base (844)..(844): a, c, t, g, unknown or other
  modified_base (865)..(865): a, c, t, g, unknown or other
  modified_base (873)..(873): a, c, t, g, unknown or other
  modified_base (883)..(883): a, c, t, g, unknown or other
  modified_base (887)..(887): a, c, t, g, unknown or other
  modified_base (892)..(892): a, c, t, g, unknown or other
  modified_base (894)..(894): a, c, t, g, unknown or other
  modified_base (923)..(923): a, c, t, g, unknown or other
  modified_base (932)..(932): a, c, t, g, unknown or other
  modified_base (938)..(938): a, c, t, g, unknown or other
  modified_base (940)..(940): a, c, t, g, unknown or other
  modified_base (954)..(954): a, c, t, g, unknown or other
  modified_base (973)..(973): a, c, t, g, unknown or other
  modified_base (978)..(978): a, c, t, g, unknown or other
  modified_base (986)..(986): a, c, t, g, unknown or other
  modified_base (1000)..(1000): a, c, t, g, unknown or other
  modified_base (1010)..(1094): a, c, t, g, unknown or other
  modified_base (1096)..(1114): a, c, t, g, unknown or other
  modified_base (1135)..(1135): a, c, t, g, unknown or other
tcatagggcnaaancttagccacntgatgatgactccnactgaattctctatagagttccaggacaaaattttcagtttctaattgtatnttctccatcttgcatttnaaaaatttaaanacattntttcntcctgattcnactaaaaagaaaaaaaattgatccctttgccaagttctttcaattaatgttantattatcccattcattngggtttgaaatctcatagcntctttaactcttctttattcctntatctaatcagccaccatctcctktcagttctntttcccnaaaaggntnacattttgnttanttgaggctgaattanacatggttgaggctgagcagtgagntgggacccctttacctntccagctnagagcatttnttngccaactgtcaagnggngaagcaagaacncngnangcagaagagctgcntttgatgtaagcagngaagagagatcagaactngtttggcctccntttctcagcntcctgcctccaccncaagtcacatatnctcccaagncntgacccattcccaaaatgaatgatcagcattcntccactaaccagaagcatgtcccagctctcttctgtgtcccaccattagaaaatcaaaagctgactktagntttgatttagttgnanttaggaattanancttcttntcactaccaatttctcccagttaatggaatatgaatrgtaatnnnnnnnnnnnnnnnnnnnnnnnnnnnnnnnnnnnnnnsnnnnnnnnnnnnnnnnnnnnnnnnnnnnnnnnnnnnnnnnnnnnnnnnnnnnnnnnnnnnnnnnnagagtcacattccaattcagcncccaccttgcattattctaanatacaccnttgatcatantgtntctcnancaaaagcttcaatggtcaagtactgaacnttgcttatntatcantnacattgctagtatncctgctataacaagttctncttantcagaatntttaaaatgtagtncaaaacacannnnnnnnnnnnnnnnnnnnnnnnnnnnnnnnnnnnnnnnnnnnnnnnnnnnnnnnnnnnnnnnnnnnnnnnnnnnnnnnnnnnnknnnnnnnnnnnnnnnnnnntaggaagtcatttgaaagaangagatg

SEQ ID NO: 4923 - DNA, 149 bp, Artificial Sequence
  Description of Artificial Sequence: Synthetic polynucleotide
  modified_base (2)..(2): a, c, t, g, unknown or other
  modified_base (7)..(7): a, c, t, g, unknown or other
  modified_base (60)..(60): a, c, t, g, unknown or other
  modified_base (80)..(80): a, c, t, g, unknown or other
  modified_base (88)..(88): a, c, t, g, unknown or other
  modified_base (104)..(104): a, c, t, g, unknown or other
  modified_base (122)..(122): a, c, t, g, unknown or other
  modified_base (127)..(127): a, c, t, g, unknown or other
  modified_base (130)..(130): a, c, t, g, unknown or other
  modified_base (133)..(133): a, c, t, g, unknown or other
cnggctngtccttgagaaactaagtgacctgcttctcagctgtrcaagtaaaaaatcttngcaacacatcatccaaaccnggctcagntgctgcagggccccangaatagggccctgccttnccttnccntcnagcatcccatctgacc

SEQ ID NO: 4924 - DNA, 494 bp, Artificial Sequence
  Description of Artificial Sequence: Synthetic polynucleotide
  modified_base (29)..(29): a, c, t, g, unknown or other
  modified_base (54)..(54): a, c, t, g, unknown or other
  modified_base (84)..(84): a, c, t, g, unknown or other
  modified_base (92)..(92): a, c, t, g, unknown or other
  modified_base (117)..(117): a, c, t, g, unknown or other
  modified_base (124)..(124): a, c, t, g, unknown or other
  modified_base (126)..(126): a, c, t, g, unknown or other
  modified_base (131)..(131): a, c, t, g, unknown or other
  modified_base (135)..(135): a, c, t, g, unknown or other
  modified_base (137)..(137): a, c, t, g, unknown or other
  modified_base (145)..(145): a, c, t, g, unknown or other
  modified_base (155)..(155): a, c, t, g, unknown or other
  modified_base (166)..(166): a, c, t, g, unknown or other
  modified_base (202)..(202): a, c, t, g, unknown or other
  modified_base (244)..(244): a, c, t, g, unknown or other
  modified_base (247)..(247): a, c, t, g, unknown or other
  modified_base (251)..(251): a, c, t, g, unknown or other
  modified_base (259)..(259): a, c, t, g, unknown or other
  modified_base (283)..(283): a, c, t, g, unknown or other
  modified_base (290)..(290): a, c, t, g, unknown or other
  modified_base (297)..(297): a, c, t, g, unknown or other
  modified_base (315)..(315): a, c, t, g, unknown or other
  modified_base (332)..(332): a, c, t, g, unknown or other
  modified_base (346)..(346): a, c, t, g, unknown or other
  modified_base (354)..(354): a, c, t, g, unknown or other
  modified_base (362)..(362): a, c, t, g, unknown or other
  modified_base (364)..(364): a, c, t, g, unknown or other
  modified_base (391)..(391): a, c, t, g, unknown or other
  modified_base (432)..(432): a, c, t, g, unknown or other
  modified_base (459)..(459): a, c, t, g, unknown or other
  modified_base (465)..(465): a, c, t, g, unknown or other
  modified_base (480)..(480): a, c, t, g, unknown or other
  modified_base (483)..(483): a, c, t, g, unknown or other
  modified_base (493)..(493): a, c, t, g, unknown or other
taaaaattagcaaaaattgaagctaaagncaagtaatttcaaacttgacataanaatcatttggatactaataattcagctatntgcaaagnacttggtaggcactgcaagcagcanagatgtntntgagnaaangnagctgttnccaaagagcntatagttaagncartgaaatcagatagcattttatctcctagaaagnaaartgttaagtgtaggtgaaacttggacagtaggatccagnttnaatncaaatagnaacttctaaaatcagaaatgtatntagcacngaggatntgcctatttgaaaacagntgaagcaaatgaggagncaagcattctcttngggaaaantgtggacnanacaaatccagcaatgacatgattaccnggaccccaaaatgttctgaaaccctgcrtaatgaccacctnaggcttatgactcctctagagtgaagnttgctntaatctttttctctnatntcttccttant

SEQ ID NO: 4925 - DNA, 324 bp, Artificial Sequence
  Description of Artificial Sequence: Synthetic polynucleotide
  modified_base (97)..(97): a, c, t, g, unknown or other
  modified_base (204)..(204): a, c, t, g, unknown or other
  modified_base (227)..(227): a, c, t, g, unknown or other
  modified_base (268)..(268): a, c, t, g, unknown or other
  modified_base (270)..(270): a, c, t, g, unknown or other
  modified_base (287)..(287): a, c, t, g, unknown or other
aattatttctttttgttgataagaatatgatattttgttggtaagaataggacatatggccttgcttagaagaaaggtgactaagaattgtagttcngaaggggagctattttccagtaacagctctacactctagaagaagatataagaaaattgatgaatacttagttcccygtaatttactctgtctcctataatctgagnttttaatttctccagtgcagtgnttatctgattatcctttgtagataatttcctttgtaagtananttctgtactagggagancttcacttttcttctttgtctactaacatacttcagg

SEQ ID NO: 4926 - DNA, 325 bp, Artificial Sequence
  Description of Artificial Sequence: Synthetic polynucleotide
  modified_base (52)..(52): a, c, t, g, unknown or other
  modified_base (169)..(169): a, c, t, g, unknown or other
  modified_base (182)..(182): a, c, t, g, unknown or other
  modified_base (252)..(252): a, c, t, g, unknown or other
gagcagcatttcaaggccctccatgctttggtctctgccaaatcactattanatttttaagatttttttttamacattatacttacattacacaatgtcttaacactatgaagtaaaaatgtaaatattttaaactctggcttggaaatgaggaggcagaatctcaganattttcctaaaanaaataggagaggcaagctttctgagtccacaaaagtgccctctacctattgggtcaaagaaaaagtaatntctctatttgtaacaacatacataaattataaaccctgaagaaataggtccctaatagctataatctttaaca

SEQ ID NO: 4927 - DNA, 617 bp, Artificial Sequence
  Description of Artificial Sequence: Synthetic polynucleotide
  modified_base (3)..(3): a, c, t, g, unknown or other
  modified_base (20)..(20): a, c, t, g, unknown or other
  modified_base (72)..(72): a, c, t, g, unknown or other
  modified_base (115)..(115): a, c, t, g, unknown or other
  modified_base (137)..(137): a, c, t, g, unknown or other
  modified_base (247)..(247): a, c, t, g, unknown or other
  modified_base (274)..(274): a, c, t, g, unknown or other
  modified_base (295)..(295): a, c, t, g, unknown or other
  modified_base (313)..(313): a, c, t, g, unknown or other
  modified_base (330)..(330): a, c, t, g, unknown or other
  modified_base (332)..(332): a, c, t, g, unknown or other
  modified_base (364)..(364): a, c, t, g, unknown or other
  modified_base (387)..(387): a, c, t, g, unknown or other
  modified_base (407)..(407): a, c, t, g, unknown or other
  modified_base (420)..(420): a, c, t, g, unknown or other
  modified_base (427)..(427): a, c, t, g, unknown or other
  modified_base (435)..(435): a, c, t, g, unknown or other
  modified_base (443)..(443): a, c, t, g, unknown or other
  modified_base (445)..(445): a, c, t, g, unknown or other
  modified_base (466)..(466): a, c, t, g, unknown or other
  modified_base (468)..(468): a, c, t, g, unknown or other
  modified_base (485)..(485): a, c, t, g, unknown or other
  modified_base (493)..(493): a, c, t, g, unknown or other
  modified_base (500)..(500): a, c, t, g, unknown or other
  modified_base (508)..(508): a, c, t, g, unknown or other
  modified_base (548)..(548): a, c, t, g, unknown or other
  modified_base (576)..(576): a, c, t, g, unknown or other
  modified_base (591)..(591): a, c, t, g, unknown or other
  modified_base (610)..(610): a, c, t, g, unknown or other
tcnaaacttttttgtttttnattaagcacattccacagtacaaagctgtcatgaataatayctgtacaattnaacagtttcaatagctgttcagacacaaatttatttcaaacanataattggcaaacataattaantacaagttagaattagactatcccagtgctttaaaacattaatatagcagtaatttacatttgctcarttatggttagcaaaataaagtccagagtatggctgggaattnactattataatcccagaaagtcagaantccttgggtgccaaagtcccntgctataatttagtaggnacaattcaaaggttgtntncatattcaaaggccatsatctcccaaggaacnaggggracttctatattaaacangcaaaaacaacaaaaaatcnattcattcattcngrattgnctcctccnctgccccntnccttccccctgggctttcctnancagtttgataytgaagntgtaggangaaaagnggtcaaanctaaatcactttcacaaccaccatcaagcttacaacatcnccttatgaatggaggtttattgtttacnctttgagactcaacntctcaaaaacataaattangtaacat

SEQ ID NO: 4928 - DNA, 370 bp, Artificial Sequence
  Description of Artificial Sequence: Synthetic polynucleotide
  modified_base (26)..(26): a, c, t, g, unknown or other
  modified_base (30)..(30): a, c, t, g, unknown or other
  modified_base (39)..(39): a, c, t, g, unknown or other
  modified_base (59)..(59): a, c, t, g, unknown or other
  modified_base (62)..(62): a, c, t, g, unknown or other
  modified_base (70)..(70): a, c, t, g, unknown or other
  modified_base (93)..(93): a, c, t, g, unknown or other
  modified_base (100)..(100): a, c, t, g, unknown or other
  modified_base (110)..(110): a, c, t, g, unknown or other
  modified_base (113)..(113): a, c, t, g, unknown or other
  modified_base (126)..(126): a, c, t, g, unknown or other
  misc_feature (196)..(197): This region may encompass 'at' or 'cc'
  modified_base (205)..(205): a, c, t, g, unknown or other
  modified_base (216)..(216): a, c, t, g, unknown or other
  modified_base (219)..(219): a, c, t, g, unknown or other
  modified_base (227)..(227): a, c, t, g, unknown or other
  modified_base (257)..(257): a, c, t, g, unknown or other
  modified_base (277)..(277): a, c, t, g, unknown or other
  modified_base (279)..(279): a, c, t, g, unknown or other
  modified_base (286)..(286): a, c, t, g, unknown or other
  modified_base (297)..(297): a, c, t, g, unknown or other
  modified_base (299)..(299): a, c, t, g, unknown or other
  modified_base (320)..(320): a, c, t, g, unknown or other
  modified_base (366)..(366): a, c, t, g, unknown or other
agtttgaagagatcygaagcccaagntagnctcaggctngaattcccactatatrcagntcnctagattnaatttaaatgtgtcttaaatttnacaaatnatgcaacagnatnaaagatgtaattnaacaaaacttgtccaagaaggtccttggtattttctctcttctggaaatcatcgatgaaaaagcatgttmyatgagctngcagaactcanycnttaagggnaaaaaaggtcatttaattgcacaataagangcatamtgtgggcagaaaananctccctnttwattgcatntntcaaattatttaggtatctangagagaaargtggatgtaccaaaaacctaggctatgtgtaatcatngaaa

SEQ ID NO: 4929 - DNA, 308 bp, Artificial Sequence
  Description of Artificial Sequence: Synthetic polynucleotide
  modified_base (35)..(35): a, c, t, g, unknown or other
  modified_base (63)..(63): a, c, t, g, unknown or other
  modified_base (73)..(73): a, c, t, g, unknown or other
  modified_base (81)..(81): a, c, t, g, unknown or other
  modified_base (220)..(220): a, c, t, g, unknown or other
  modified_base (261)..(261): a, c, t, g, unknown or other
  modified_base (272)..(272): a, c, t, g, unknown or other
  modified_base (304)..(304): a, c, t, g, unknown or other
tatatcaactggtaaaactttattttacaagcaanaggaattggatcaaatgattattataanccagaggaantattttgnaaccacagcaaatgccattatacatactgccaatacasatttaatagacaatactgaactgtacaagagttatttatttttccttaatctcraagcyatttttagtaatacaaaaaagccatattaacatttttttccngttagaaaacatgatgtacaaaactttggatgaraagatangtcaaatttcntttaatcacttggaggaaaatccaccaactcntcaa

SEQ ID NO: 4930 - DNA, 471 bp, Artificial Sequence
  Description of Artificial Sequence: Synthetic polynucleotide
  modified_base (35)..(35): a, c, t, g, unknown or other
  modified_base (42)..(42): a, c, t, g, unknown or other
  modified_base (67)..(67): a, c, t, g, unknown or other
  modified_base (72)..(72): a, c, t, g, unknown or other
  modified_base (99)..(99): a, c, t, g, unknown or other
  modified_base (101)..(101): a, c, t, g, unknown or other
  modified_base (118)..(118): a, c, t, g, unknown or other
  modified_base (120)..(120): a, c, t, g, unknown or other
  modified_base (171)..(171): a, c, t, g, unknown or other
  modified_base (173)..(173): a, c, t, g, unknown or other
  modified_base (177)..(177): a, c, t, g, unknown or other
  modified_base (193)..(193): a, c, t, g, unknown or other
  modified_base (204)..(204): a, c, t, g, unknown or other
  modified_base (212)..(212): a, c, t, g, unknown or other
  modified_base (229)..(229): a, c, t, g, unknown or other
  modified_base (238)..(238): a, c, t, g, unknown or other
  modified_base (311)..(311): a, c, t, g, unknown or other
  modified_base (381)..(381): a, c, t, g, unknown or other
  modified_base (400)..(400): a, c, t, g, unknown or other
  modified_base (404)..(404): a, c, t, g, unknown or other
tgaccataggctttstygagattagaaataactgnttctttnaaagagaatgcctgcattaaccaantatanaagatatgtagcaaatgctacatttgnantcatcataaagctgaangnaaaaagaaacactgcaaacatactgaaacaattaagcaatgttcgttcctnantttnggctgggaagaatatnctttgtgcacngtatagtnrgtaagacaacattctnaggcccacnttttagttagttaccaactcctagaagccartggaaaatcacagtctttgatgtgtaaaataactgagaaaangggtrtagagccttataaaatacctgagcttcatctggaccagccaggagcaagacttgaaatcctcttnctgaggaaaatgaaggaangcanacttgccttttgaggcacaaaataaaagaaacctataaaatttgkgtggcacartgtcccagaaatc

SEQ ID NO: 4931 - DNA, 102 bp, Artificial Sequence
  Description of Artificial Sequence: Synthetic polynucleotide
  modified_base (37)..(37): a, c, t, g, unknown or other
  modified_base (67)..(67): a, c, t, g, unknown or other
aacctgttcagtgctgccagtcaacrgagcgtctgtngagtagcagcgtgggatcaggcagcagggnttttttttccccgttgctttcgttcctttgcagga

SEQ ID NO: 4932 - DNA, 611 bp, Artificial Sequence
  Description of Artificial Sequence: Synthetic polynucleotide
  modified_base (1)..(1): a, c, t, g, unknown or other
  modified_base (3)..(3): a, c, t, g, unknown or other
  modified_base (43)..(43): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (134)..(134): a, c, t, g, unknown or other
  modified_base (140)..(140): a, c, t, g, unknown or other
  modified_base (156)..(156): a, c, t, g, unknown or other
  modified_base (179)..(179): a, c, t, g, unknown or other
  modified_base (189)..(189): a, c, t, g, unknown or other
  modified_base (200)..(200): a, c, t, g, unknown or other
  modified_base (238)..(238): a, c, t, g, unknown or other
  modified_base (249)..(249): a, c, t, g, unknown or other
  modified_base (257)..(257): a, c, t, g, unknown or other
  modified_base (262)..(262): a, c, t, g, unknown or other
  modified_base (267)..(267): a, c, t, g, unknown or other
  modified_base (278)..(278): a, c, t, g, unknown or other
  modified_base (349)..(349): a, c, t, g, unknown or other
  modified_base (365)..(365): a, c, t, g, unknown or other
  modified_base (382)..(382): a, c, t, g, unknown or other
  modified_base (412)..(412): a, c, t, g, unknown or other
  modified_base (421)..(421): a, c, t, g, unknown or other
  modified_base (423)..(423): a, c, t, g, unknown or other
  modified_base (450)..(450): a, c, t, g, unknown or other
  modified_base (473)..(473): a, c, t, g, unknown or other
  modified_base (531)..(531): a, c, t, g, unknown or other
  modified_base (535)..(535): a, c, t, g, unknown or other
  modified_base (541)..(541): a, c, t, g, unknown or other
  modified_base (571)..(571): a, c, t, g, unknown or other
  modified_base (573)..(573): a, c, t, g, unknown or other
  modified_base (575)..(575): a, c, t, g, unknown or other
  modified_base (580)..(580): a, c, t, g, unknown or other
  modified_base (600)..(600): a, c, t, g, unknown or other
  modified_base (608)..(608): a, c, t, g, unknown or other
nanatttacttttaatctcatgagatgctgaggactaagaccncctccttcccagggcccaaagcaagaaaatgnggntgngangaggcccatctccanagatcttacccttggaataagggtctttttcccanacctcnttgacatctattcccnctgggctgtttttattttcctancccacactcntcagctttaangcactaaagaactttttggccacctcagracaaaaatntgttacaaaancacctccnaaatnraatnagctsagcctnactaagtaaatcaggctttggacaggctcygcttcctgttggttgttcatacatttgtgttgctcaagtcnatcttagaacccaacnccgccttgctggattcntgatggaatttctctttgcacctgaacaantcttcaggnancttctccttttaattttgaagaatgtnatacctttctgtcagaaaaggtntccaggtcttagattcacactcaagccatgaataatactcttctgggcatacataaanacangatttncccaaattctccttctcctagcacagagancncncttcnttccttccctttccctagcnttctttcnaat

SEQ ID NO: 4933 - DNA, 198 bp, Artificial Sequence
  Description of Artificial Sequence: Synthetic polynucleotide
  modified_base (21)..(21): a, c, t, g, unknown or other
  modified_base (30)..(30): a, c, t, g, unknown or other
  modified_base (80)..(80): a, c, t, g, unknown or other
  modified_base (83)..(83): a, c, t, g, unknown or other
  modified_base (161)..(161): a, c, t, g, unknown or other
  modified_base (186)..(186): a, c, t, g, unknown or other
tatcaagtactttgtccattngcaggcagntgttaaatacagcagttggctcgtgtggatacagtactgcagagaaaganccnctctgtgaagatttgagcagcatggtcagtgaatgcagagaatgaggcaygatagracctgtaatctccaaactaaantggtctctgtatccagaaagagctngtgtcttcacat

SEQ ID NO: 4934 - DNA, 2420 bp, Artificial Sequence
  Description of Artificial Sequence: Synthetic polynucleotide
  modified_base (2)..(2): a, c, t, g, unknown or other
  modified_base (18)..(18): a, c, t, g, unknown or other
  modified_base (102)..(102): a, c, t, g, unknown or other
  modified_base (139)..(139): a, c, t, g, unknown or other
  modified_base (152)..(191): a, c, t, g, unknown or other
  modified_base (212)..(212): a, c, t, g, unknown or other
  modified_base (244)..(244): a, c, t, g, unknown or other
  modified_base (252)..(252): a, c, t, g, unknown or other
  modified_base (262)..(262): a, c, t, g, unknown or other
  modified_base (286)..(286): a, c, t, g, unknown or other
  modified_base (372)..(372): a, c, t, g, unknown or other
  modified_base (379)..(379): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (419)..(419): a, c, t, g, unknown or other
  modified_base (442)..(442): a, c, t, g, unknown or other
  modified_base (465)..(465): a, c, t, g, unknown or other
  modified_base (482)..(482): a, c, t, g, unknown or other
  modified_base (528)..(528): a, c, t, g, unknown or other
  modified_base (539)..(539): a, c, t, g, unknown or other
  modified_base (543)..(543): a, c, t, g, unknown or other
  modified_base (555)..(555): a, c, t, g, unknown or other
  modified_base (573)..(573): a, c, t, g, unknown or other
  modified_base (576)..(576): a, c, t, g, unknown or other
  modified_base (583)..(583): a, c, t, g, unknown or other
  modified_base (597)..(597): a, c, t, g, unknown or other
  modified_base (603)..(603): a, c, t, g, unknown or other
  modified_base (628)..(628): a, c, t, g, unknown or other
  modified_base (653)..(653): a, c, t, g, unknown or other
  modified_base (668)..(668): a, c, t, g, unknown or other
  modified_base (678)..(678): a, c, t, g, unknown or other
  modified_base (688)..(688): a, c, t, g, unknown or other
  modified_base (720)..(720): a, c, t, g, unknown or other
  modified_base (728)..(728): a, c, t, g, unknown or other
  modified_base (735)..(735): a, c, t, g, unknown or other
  modified_base (737)..(737): a, c, t, g, unknown or other
  modified_base (765)..(765): a, c, t, g, unknown or other
  modified_base (767)..(767): a, c, t, g, unknown or other
  modified_base (789)..(789): a, c, t, g, unknown or other
  modified_base (807)..(807): a, c, t, g, unknown or other
  modified_base (809)..(809): a, c, t, g, unknown or other
  modified_base (823)..(823): a, c, t, g, unknown or other
  modified_base (833)..(833): a, c, t, g, unknown or other
  modified_base (871)..(871): a, c, t, g, unknown or other
  modified_base (913)..(913): a, c, t, g, unknown or other
  modified_base (923)..(923): a, c, t, g, unknown or other
  modified_base (925)..(925): a, c, t, g, unknown or other
  modified_base (992)..(992): a, c, t, g, unknown or other
  modified_base (1031)..(1031): a, c, t, g, unknown or other
  modified_base (1048)..(1048): a, c, t, g, unknown or other
  modified_base (1082)..(1082): a, c, t, g, unknown or other
  modified_base (1088)..(1088): a, c, t, g, unknown or other
  modified_base (1097)..(1097): a, c, t, g, unknown or other
  modified_base (1169)..(1169): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1246)..(1246): a, c, t, g, unknown or other
  modified_base (1258)..(1258): a, c, t, g, unknown or other
  modified_base (1268)..(1268): a, c, t, g, unknown or other
  modified_base (1328)..(1328): a, c, t, g, unknown or other
  modified_base (1333)..(1333): a, c, t, g, unknown or other
  modified_base (1342)..(1342): a, c, t, g, unknown or other
  modified_base (1347)..(1347): a, c, t, g, unknown or other
  modified_base (1361)..(1361): a, c, t, g, unknown or other
  modified_base (1369)..(1369): a, c, t, g, unknown or other
  modified_base (1371)..(1371): a, c, t, g, unknown or other
  modified_base (1408)..(1408): a, c, t, g, unknown or other
  modified_base (1469)..(1469): a, c, t, g, unknown or other
  modified_base (1471)..(1471): a, c, t, g, unknown or other
  modified_base (1482)..(1482): a, c, t, g, unknown or other
  modified_base (1544)..(1544): a, c, t, g, unknown or other
  modified_base (1561)..(1561): a, c, t, g, unknown or other
  modified_base (1628)..(1628): a, c, t, g, unknown or other
  modified_base (1665)..(1665): a, c, t, g, unknown or other
  modified_base (1716)..(1716): a, c, t, g, unknown or other
  modified_base (1838)..(1838): a, c, t, g, unknown or other
  modified_base (1847)..(1847): a, c, t, g, unknown or other
  modified_base (1882)..(1882): a, c, t, g, unknown or other
  modified_base (1941)..(1941): a, c, t, g, unknown or other
  modified_base (2000)..(2000): a, c, t, g, unknown or other
  modified_base (2058)..(2058): a, c, t, g, unknown or other
  modified_base (2098)..(2098): a, c, t, g, unknown or other
  modified_base (2117)..(2117): a, c, t, g, unknown or other
  modified_base (2126)..(2126): a, c, t, g, unknown or other
  modified_base (2186)..(2186): a, c, t, g, unknown or other
  modified_base (2202)..(2202): a, c, t, g, unknown or other
  modified_base (2220)..(2220): a, c, t, g, unknown or other
  modified_base (2230)..(2230): a, c, t, g, unknown or other
  modified_base (2246)..(2246): a, c, t, g, unknown or other
  modified_base (2248)..(2248): a, c, t, g, unknown or other
  modified_base (2276)..(2276): a, c, t, g, unknown or other
  modified_base (2290)..(2290): a, c, t, g, unknown or other
  modified_base (2292)..(2292): a, c, t, g, unknown or other
  modified_base (2398)..(2398): a, c, t, g, unknown or other
  modified_base (2407)..(2407): a, c, t, g, unknown or other
cnacccaaagtgttttangcagtgaataaaatcaaaataatgcatcttaataaattccagctgttaaaagaacaaacttagcaatatatracagtttgctancaggatttttgactattcactttgggagttatttttnaaaatccactttnnnnnnnnnnnnnnnnnnnnnnnnnnnnnnnnnnnnnnnncatctaggtaactaagaaaangttggttaagataggaaagacccataaatcantcctttgnttaccaaatncaatttttaactttcaaacatccnccaagatcaagaaaccctaactaaaaatacayacccttctaagtgttatttgattttattagtagcaagggtgtttggtaaggtcntgaaccnctatttttgatccattattccaattaanangngtcaaaanctaakttgttatttttctaatgngtttaagatytggcattcagttnttacacatgtggttcantgatttatcatgaaccctaaactgcacactgctcaaaaacagcaanacagatgtgcnttanatgaaataatgntttttgatacatatcttnaanttcaatncagtttagggtccntgaagnaaaagatatccagttatcgggtggnaaagagcagagraggtaaactagtnaagattattaakatncagtgaagtnttattgtctntcttatcctttgagtaacaagatgctaacacnctttcaanaaaaaankntgcttaaaactatgctaaaggcccatgnrntgacatcatccattcaacaccnttactttgttacataaancngttttcttaaggtnaacatattangcaataatttggaaattagccaagcactaagcaattanaatagcaggtaatacaccatcaatttttgaaacacatttggncacatttcananccatctgcagtatggawtctatagactctcactcagtttaaaatttgtttctggacctgaatgacangagaatggctttatgaaattttctcataagacatttaantagtcttaggttcacancccttttgttgtaaatgatttaatctgacatgcnatatanctacaatanaaataattatgttcaattcttaaatgaaaactaaatgccaataaatggtaacagatttgacatggaatgttntaagatcttcctctacrtaatctgncangcngattatgaatttcagagcttgaaaacttcagattaagaaccacaanaaaatttactcntgatgrcatncaagatcttcctaaaaattaacctaagacctagaagtctcagtattattagaacataaanaaacncaacaaatntgtanattttattcacatntatttttngnttttagtgtgctcacagaaaattagaacaccttaagnaggagtttaatagcaatttttgtaagcaaagttacattccatctctaagtcaaattggtcnangcttctccagnattkacaaaacatgatagacaagatgctacacaaaaccattgcatctgaagatttttttttncytttattctcaaagangactggaaargaaagcattatctgctgtaatcaaaaacataccacagtataaacagtaaccattccncttatcacagcttggttgagtttaaaatttgtgtttnaaaaggtccaagatgactgcagttttacaaaaatgggcagggtggaaagtnrcaaacttcatgtgcttctggatatcaagatttgtttttatacaatagtcacagttaaaaacaccctgctggtaatacrtaattacactttattaaggtcataaaccagcaataaacaatanagcmtatanaacttgtagttctacttaatcactgactggtacanctaacatgagataagtgaaaagttcctatggtttaaatgaactcctaagactatgatcntttttttttttwwaawtmtgggtattggtgttttttcttttttyctctttycttcttantcaagacttgtagtgttgtaaacctgcctcacaaaatacatggtaataacttttcttnaaaaaaaaagacagcctttacaccatttctagtggcacantattttggcaatgttatgnaccacttcnatttccccattgtgacccctatcacttcatttgatatccctttttgacccacccatctcnttcatatatgggcatntccatagaytgacaaagnaagtttacanttttgrataaagatgnanagtatgcmaaaacattaatactgatgmnaaaaaataaaaaananagaaacaaggcagaggaagaaggtgtttaagctctcctcgacctgttggaatggtggttaacagaatgatttgagatgggatctgtggggaggggagaaaaaaaancaaaatttngtgcttaaaaaaa

SEQ ID NO: 4935 - DNA, 463 bp, Artificial Sequence
  Description of Artificial Sequence: Synthetic polynucleotide
  modified_base (123)..(123): a, c, t, g, unknown or other
  modified_base (245)..(245): a, c, t, g, unknown or other
  modified_base (308)..(308): a, c, t, g, unknown or other
  modified_base (337)..(337): a, c, t, g, unknown or other
  modified_base (385)..(385): a, c, t, g, unknown or other
  modified_base (425)..(425): a, c, t, g, unknown or other
  modified_base (446)..(446): a, c, t, g, unknown or other
tcagacyctgactcacgctaccgcccctgccacccccagttgtttcagaagtgctgcctggggcagaggatcctggaggcctgggaagccaaygaccacacacagtaagagccactcggacanggagggacccagcctggccagtcagggatgcagaracgcacctcagccgggcactggtgatgctgcgtgcaggactgcatgctctggtggagcgctgggtgtgcgacacagctccacactcnaggctgccatgcraggggccctcctactgggtggacagctgcaaatgctacttggggaggggncacagggagctgacrggaagcagtcccanccccaccaggcacctgctctggcccctgcccagcctggcttgcctagnctttgccctcttgcgggtcccctgtccattcctgatcttnccccaagaactcgggtgctcnatcagcactcrcacatg

SEQ ID NO: 4936 - DNA, 631 bp, Artificial Sequence
  Description of Artificial Sequence: Synthetic polynucleotide
  modified_base (37)..(37): a, c, t, g, unknown or other
  modified_base (58)..(58): a, c, t, g, unknown or other
  modified_base (61)..(61): a, c, t, g, unknown or other
  modified_base (89)..(89): a, c, t, g, unknown or other
  modified_base (102)..(102): a, c, t, g, unknown or other
  modified_base (134)..(134): a, c, t, g, unknown or other
  modified_base (138)..(138): a, c, t, g, unknown or other
  modified_base (144)..(144): a, c, t, g, unknown or other
  modified_base (148)..(148): a, c, t, g, unknown or other
  modified_base (171)..(171): a, c, t, g, unknown or other
  modified_base (177)..(177): a, c, t, g, unknown or other
  modified_base (191)..(191): a, c, t, g, unknown or other
  modified_base (201)..(201): a, c, t, g, unknown or other
  modified_base (205)..(205): a, c, t, g, unknown or other
  modified_base (215)..(215): a, c, t, g, unknown or other
  modified_base (231)..(231): a, c, t, g, unknown or other
  modified_base (256)..(256): a, c, t, g, unknown or other
  modified_base (295)..(295): a, c, t, g, unknown or other
  modified_base (319)..(319): a, c, t, g, unknown or other
  modified_base (327)..(327): a, c, t, g, unknown or other
  modified_base (356)..(356): a, c, t, g, unknown or other
  modified_base (392)..(392): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (447)..(447): a, c, t, g, unknown or other
  modified_base (454)..(454): a, c, t, g, unknown or other
  modified_base (480)..(480): a, c, t, g, unknown or other
  modified_base (486)..(486): a, c, t, g, unknown or other
  modified_base (493)..(493): a, c, t, g, unknown or other
  modified_base (529)..(529): a, c, t, g, unknown or other
  modified_base (546)..(546): a, c, t, g, unknown or other
  modified_base (554)..(554): a, c, t, g, unknown or other
  modified_base (570)..(570): a, c, t, g, unknown or other
  modified_base (575)..(575): a, c, t, g, unknown or other
  modified_base (590)..(590): a, c, t, g, unknown or other
  modified_base (617)..(617): a, c, t, g, unknown or other
  modified_base (620)..(620): a, c, t, g, unknown or other
ctgaaacagcaattgggaggcccattttactggccantatataattmcattagtaagnagnctagcaaagaataatcatatcaatttcntaatcagctgcanccatgctgaatttgaactggcaaactctgatntgtnagttgntagntgtgatcttcatatcactaaaangaacangataccattctaanaactttacanaganatagtctagnagacattgttctgccntggtcacagtaacaaaaaagtggtnaaaatcagttactttataaatactgataatttgcagcantaaggaacaggacattaaaaaaantaaatttncccataggacacctatgactaggaastcnttcctaagagaagccaaagttttaattattcagttncacaactantgtactgggttacntantctaagaaagaaaaggtgctctacagagntttcccncacacacaaagaatcagcrttaattnagcatnatctctntcattcacagatctggcagattcattaactcatttnaaatgaataaggccaanaggatgcnggaaggtgtggctgantgagntccagggctgtatcncagcttattgatggcaccccattaggnaantgaatacraag

SEQ ID NO: 4937 - DNA, 1350 bp, Artificial Sequence
  Description of Artificial Sequence: Synthetic polynucleotide
  modified_base (8)..(8): a, c, t, g, unknown or other
  modified_base (10)..(10): a, c, t, g, unknown or other
  modified_base (12)..(12): a, c, t, g, unknown or other
  modified_base (76)..(76): a, c, t, g, unknown or other
  modified_base (94)..(94): a, c, t, g, unknown or other
  modified_base (106)..(106): a, c, t, g, unknown or other
  modified_base (109)..(109): a, c, t, g, unknown or other
  modified_base (125)..(125): a, c, t, g, unknown or other
  modified_base (128)..(128): a, c, t, g, unknown or other
  modified_base (215)..(215): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
  modified_base (518)..(518): a, c, t, g, unknown or other
  modified_base (523)..(523): a, c, t, g, unknown or other
  modified_base (533)..(533): a, c, t, g, unknown or other
  modified_base (559)..(559): a, c, t, g, unknown or other
  modified_base (589)..(589): a, c, t, g, unknown or other
  modified_base (609)..(609): a, c, t, g, unknown or other
  modified_base (702)..(702): a, c, t, g, unknown or other
  modified_base (706)..(706): a, c, t, g, unknown or other
  modified_base (728)..(728): a, c, t, g, unknown or other
  modified_base (731)..(731): a, c, t, g, unknown or other
  modified_base (744)..(744): a, c, t, g, unknown or other
  modified_base (770)..(770): a, c, t, g, unknown or other
  modified_base (788)..(788): a, c, t, g, unknown or other
  modified_base (881)..(881): a, c, t, g, unknown or other
  modified_base (946)..(946): a, c, t, g, unknown or other
  modified_base (956)..(956): a, c, t, g, unknown or other
  modified_base (1020)..(1020): a, c, t, g, unknown or other
  modified_base (1069)..(1069): a, c, t, g, unknown or other
  modified_base (1109)..(1109): a, c, t, g, unknown or other
  modified_base (1147)..(1147): a, c, t, g, unknown or other
  modified_base (1151)..(1151): a, c, t, g, unknown or other
  modified_base (1249)..(1287): a, c, t, g, unknown or other
  modified_base (1332)..(1332): a, c, t, g, unknown or other
  modified_base (1336)..(1336): a, c, t, g, unknown or other
gaaaaatnancnaatttataaaataaattgaggtgtttggatgaaaaaaaatacaagagctttgccttcatgtctnagatctcttaatatattnttggtcttgcanctnagatatcaaataaagntanctagcttgacacaaaagttggtagctgcaaggttaagctgtattagtttgatgatgggccaggaaatgatatattttctaaattttntccttaaatattggctgtaacaaatgctgatatagcaaaangtaagcttctattagacagcaagagggaaacttgagtgaatgaatgcaacttacctccaagtcctcttaaaggaggtaaaanaataaatactgtgttttaccagtgctccccncaaagcattattctaagcatgcaggagggtatagtgagcagctacaatagtaagatccaacccagaggtaggttcaaggccaagagtaggagagtggttgaggaaatcctcctagggccagtaccatttcatagaatgcccatttgtgntgggngatgaktctnggcctattttcttctgattcaaaagnacattcccaatttcaaccttgctgaaaaanaggcatttttgtacctgctnttaagaacagctaggatacaggataaggctggcataaaattatttagcaagcacatgctagctattccagtttgaaatctaccaaactgtaanatyngggagaaataaamagttgaagntgnttgttcctcaagntgagggaacaaaatcttacaaaaggngggattaggcactcgctnaactctatatggagaacatccttctcaagctaggtggaagatgaggaagaatattaccaaaagctgaccaggccatttggagaccaaaagganaggaaaaaaggcatttaggaagcaagctagtaaaagaagttcttctgggtctgactargtaagtnaatctaaggnaaccataccaaagatatgttacccattactccagcatgaagccagtggcaaaatacctcaaganattttaaayccagagaagtgtatgaaaaatatgatasttaaccaagcanattaaaatcaaaccactaatggtaaaaatctcttcagatntgaaatccaagatactcactttccattaattctgtgtnttangggggaaaagaaaagtaacaaaygtaaagattttttttatttctactggggagggaggaggataaatagaactgttttccaatttgctctcyactgtnnnnnnnnnnnnnnnnnnnnnnnnnnnnnnnnnnnnnnnccaaaaataccccaaacmaaaaacaaaaaaaccaggaatcaaaanccanaacaccctcaaact

SEQ ID NO: 4938 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2882)..(2882): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagrcatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatnaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4939 - DNA, 260 bp, Artificial Sequence
  Description of Artificial Sequence: Synthetic polynucleotide
  modified_base (15)..(15): a, c, t, g, unknown or other
  modified_base (44)..(44): a, c, t, g, unknown or other
  modified_base (74)..(74): a, c, t, g, unknown or other
  modified_base (96)..(96): a, c, t, g, unknown or other
  modified_base (149)..(149): a, c, t, g, unknown or other
  modified_base (188)..(188): a, c, t, g, unknown or other
  modified_base (200)..(200): a, c, t, g, unknown or other
  modified_base (204)..(204): a, c, t, g, unknown or other
  modified_base (207)..(207): a, c, t, g, unknown or other
  modified_base (209)..(209): a, c, t, g, unknown or other
  modified_base (212)..(212): a, c, t, g, unknown or other
  modified_base (214)..(214): a, c, t, g, unknown or other
  modified_base (225)..(225): a, c, t, g, unknown or other
  modified_base (228)..(228): a, c, t, g, unknown or other
  modified_base (246)..(246): a, c, t, g, unknown or other
ctcataattttagtntatcttttagctttatgttgcyataaacntttcattatatacatgatcaacaacagcanattatctcacctcagtatttanttattttacaaactgatttatgattrctaacatgtaactgaaggtatacactnttagaacacagttttcagtagaaagtagcactgccattnagtaataaaatnttynaanantanancaacattcttntanaagtttgcatgttgtttnctgaggtctaaagc

SEQ ID NO: 4940 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (494)..(494): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctnctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgyggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4941 - DNA, 199 bp, Artificial Sequence
  Description of Artificial Sequence: Synthetic polynucleotide
  modified_base (21)..(21): a, c, t, g, unknown or other
  modified_base (27)..(27): a, c, t, g, unknown or other
  misc_feature (29)..(30): This region may encompass 'ac' or 'gt'
  modified_base (79)..(79): a, c, t, g, unknown or other
  modified_base (85)..(85): a, c, t, g, unknown or other
  modified_base (96)..(96): a, c, t, g, unknown or other
  modified_base (122)..(122): a, c, t, g, unknown or other
  modified_base (128)..(128): a, c, t, g, unknown or other
  modified_base (131)..(131): a, c, t, g, unknown or other
  modified_base (133)..(133): a, c, t, g, unknown or other
  modified_base (140)..(140): a, c, t, g, unknown or other
  modified_base (142)..(142): a, c, t, g, unknown or other
  modified_base (159)..(159): a, c, t, g, unknown or other
  modified_base (164)..(164): a, c, t, g, unknown or other
  modified_base (185)..(185): a, c, t, g, unknown or other
  modified_base (193)..(193): a, c, t, g, unknown or other
acagtgtcctgattagtgccncagggngryatggctagagcactaagaaacaactaaagctaacaaaccagtctggcanggaacnagagggagggntgttctttctcagttaagctttatantggtgntgnanctaagangngcatcacatcagcaatngctcntaataaaaaataatcatgggntgaacttnatgtat

SEQ ID NO: 4942 - DNA, 250 bp, Artificial Sequence
  Description of Artificial Sequence: Synthetic polynucleotide
  modified_base (3)..(3): a, c, t, g, unknown or other
  modified_base (24)..(24): a, c, t, g, unknown or other
  modified_base (28)..(28): a, c, t, g, unknown or other
  modified_base (34)..(34): a, c, t, g, unknown or other
  modified_base (40)..(40): a, c, t, g, unknown or other
  modified_base (44)..(44): a, c, t, g, unknown or other
  modified_base (51)..(51): a, c, t, g, unknown or other
  modified_base (92)..(92): a, c, t, g, unknown or other
  modified_base (96)..(96): a, c, t, g, unknown or other
  modified_base (126)..(126): a, c, t, g, unknown or other
  modified_base (147)..(147): a, c, t, g, unknown or other
  modified_base (153)..(153): a, c, t, g, unknown or other
  modified_base (199)..(199): a, c, t, g, unknown or other
  modified_base (214)..(214): a, c, t, g, unknown or other
  modified_base (217)..(217): a, c, t, g, unknown or other
  modified_base (220)..(220): a, c, t, g, unknown or other
  modified_base (231)..(231): a, c, t, g, unknown or other
  modified_base (243)..(243): a, c, t, g, unknown or other
acnttcctgayatcaagttccctnagangtgaantttaancagnatgctanttgaattttaatcagaatcatagagtaaaaattgcyctggnagantgttttatagaaactctagaaaaacccagngaaatatgcctactccacaantgtatntgctgttctaatgaccagataatggaatccccaaatacagtagccntttaccattaaaagnatnagntgttttggaanagagagagtgangagaagc

SEQ ID NO: 4943 - DNA, 169 bp, Artificial Sequence
  Description of Artificial Sequence: Synthetic polynucleotide
  modified_base (25)..(25): a, c, t, g, unknown or other
  modified_base (32)..(32): a, c, t, g, unknown or other
  modified_base (44)..(44): a, c, t, g, unknown or other
  modified_base (50)..(50): a, c, t, g, unknown or other
  misc_feature (80)..(83): This region may encompass 'aact' or is absent in its entirety
  modified_base (100)..(100): a, c, t, g, unknown or other
  modified_base (150)..(150): a, c, t, g, unknown or other
  modified_base (153)..(153): a, c, t, g, unknown or other
agagtggttacttctaaaatgacangatgatntaaccctggctnaggganagatcaagttctaaatctcaggaataaaaaactgayactcattrtccaancatatagtcttgtaytatayacatattaacagtctatgcaatgaaaaatnaanagaaatttcataaaac

SEQ ID NO: 4944 - DNA, 154 bp, Artificial Sequence
  Description of Artificial Sequence: Synthetic polynucleotide
  modified_base (2)..(2): a, c, t, g, unknown or other
  modified_base (42)..(42): a, c, t, g, unknown or other
  modified_base (48)..(48): a, c, t, g, unknown or other
  modified_base (121)..(121): a, c, t, g, unknown or other
tnctgtatattaaccggctaactggtacattagctggagganagaagncacaaactacctagatgacacaaatattctttgactgatatgatttcagggggacrgtgtctggtactccaangtatgagggcatttatacaygggacacatagag

SEQ ID NO: 4945 - DNA, 1742 bp, Artificial Sequence
  Description of Artificial Sequence: Synthetic polynucleotide
  modified_base (18)..(18): a, c, t, g, unknown or other
  modified_base (33)..(33): a, c, t, g, unknown or other
  modified_base (39)..(39): a, c, t, g, unknown or other
  modified_base (81)..(81): a, c, t, g, unknown or other
  modified_base (97)..(97): a, c, t, g, unknown or other
  modified_base (119)..(119): a, c, t, g, unknown or other
  modified_base (271)..(271): a, c, t, g, unknown or other
  modified_base (321)..(321): a, c, t, g, unknown or other
  misc_feature (351)..(351): May or may not be present
  modified_base (383)..(383): a, c, t, g, unknown or other
  modified_base (408)..(408): a, c, t, g, unknown or other
  modified_base (437)..(437): a, c, t, g, unknown or other
  modified_base (526)..(526): a, c, t, g, unknown or other
  modified_base (547)..(547): a, c, t, g, unknown or other
  modified_base (577)..(577): a, c, t, g, unknown or other
  modified_base (635)..(635): a, c, t, g, unknown or other
  modified_base (728)..(728): a, c, t, g, unknown or other
  modified_base (732)..(732): a, c, t, g, unknown or other
  modified_base (742)..(742): a, c, t, g, unknown or other
  modified_base (756)..(756): a, c, t, g, unknown or other
  modified_base (777)..(777): a, c, t, g, unknown or other
  modified_base (795)..(795): a, c, t, g, unknown or other
  modified_base (837)..(837): a, c, t, g, unknown or other
  modified_base (848)..(848): a, c, t, g, unknown or other
  modified_base (887)..(887): a, c, t, g, unknown or other
  modified_base (898)..(898): a, c, t, g, unknown or other
  modified_base (907)..(907): a, c, t, g, unknown or other
  modified_base (912)..(912): a, c, t, g, unknown or other
  modified_base (956)..(956): a, c, t, g, unknown or other
  modified_base (958)..(958): a, c, t, g, unknown or other
  modified_base (981)..(981): a, c, t, g, unknown or other
  modified_base (1077)..(1077): a, c, t, g, unknown or other
  modified_base (1153)..(1153): a, c, t, g, unknown or other
  modified_base (1260)..(1260): a, c, t, g, unknown or other
  modified_base (1264)..(1264): a, c, t, g, unknown or other
  modified_base (1359)..(1359): a, c, t, g, unknown or other
  modified_base (1364)..(1364): a, c, t, g, unknown or other
  modified_base (1373)..(1373): a, c, t, g, unknown or other
  modified_base (1381)..(1381): a, c, t, g, unknown or other
  modified_base (1385)..(1385): a, c, t, g, unknown or other
  modified_base (1388)..(1388): a, c, t, g, unknown or other
  modified_base (1390)..(1390): a, c, t, g, unknown or other
  modified_base (1394)..(1394): a, c, t, g, unknown or other
  modified_base (1446)..(1446): a, c, t, g, unknown or other
  modified_base (1464)..(1464): a, c, t, g, unknown or other
  modified_base (1470)..(1470): a, c, t, g, unknown or other
  modified_base (1499)..(1499): a, c, t, g, unknown or other
  modified_base (1515)..(1515): a, c, t, g, unknown or other
  modified_base (1534)..(1534): a, c, t, g, unknown or other
  modified_base (1536)..(1536): a, c, t, g, unknown or other
  modified_base (1592)..(1592): a, c, t, g, unknown or other
  modified_base (1697)..(1697): a, c, t, g, unknown or other
taattatttttaaaggancayaaccaagactcngaaagnttgagggtaaagttggaattaacagaggaaatatakttttgnaagaaaattgtgacanggtttayaatctaggttaatcnaatcaaacagagaaaaggggaataaaaacttyattktcagtggggaatgggagaaawtttatatctttaayatttataatcatttacattcacaaaatgagattctgaattataaatcattgcaggaagtaaaagaagagaaaartagaaanmaattttgcctcaaaacagycaagcatttcaattacaaccrtcaatccangttacctctattaagcttttcaaaagataacatttttrtaacacaaaagaatccaaaataanratgtgaaaagataaccattcaacngttaaactaacaccctacgtggccatagngtcaggcaaagcaaaatacctgcccttcctgatccctcaacaaaaaacacattacatagaataaagaacaatttyatactggtaaaaancacaatatattaacactggcntgacctacttgctaaataacagccacaagntatttgtttaaaaatatgataaattgataggaacaattaatagtggtcaattgtaacnttgttgaatcaacaagtcaaaaaataaggtaaaaggacttcatctaactaaatgaaattaataaacacaaatgctacacctttaaaaagtcantacnaagtatcaanacatttattttaanaaacctaccttagttaaattntctgattaaatgaaatgnaagcataaattaacatacttcagcacaacttaaaaaaaasanaagwtattcgntaaggtatatacatacataaagttacaaatacaataaanttggcttcagncaaagctanagccnaaggtaaacttatagtcttaaatgtcctttttccttaggaaagnanaatgaattacaaattcaacttcntattaaaartaaaaaggcaagtagaggaactgagtgaagataagagtgtaaatatacaaatyagtcaaayagcagagtttttcctttccaatgatngtcattcagcaagagaaggaatctgaactacctgaggaagcaggccagagttcatcacaatccttcagccctcagncccacttcccaggtagccacagctgagcacagttacccagcagctctttttccccccaggagagaaagcccctcccctcaayccccaccactcaggcagatgcctantagnacttgctgaagaccacaawagaacctggtaatactgcttgcagttctaggtgccaaacytcactggcgaggacagggtgcaggtacagaatctcnctgcntctgctccnacctcctncccncancngggnacctggggttctggccacatcaccctcctttcccaggccctccacctcctcnctagaaaaagcagttccnagaagngcaatgacaatgctgtgccttccactccngcacacgggccatcangccctctccagctccaggnanaacccgctccaggcccatgcagcacctgagggtcatctccatccctcaacctcgcnacaccagcagcccaggaagactaagcttaaaagctaaaccgcaccttggattccaagggctatctccactaccccactgcccccaacccggctctgaacgcctcnccctgaaggggcagaagccaagtgaggtaggaagttagttaatga

SEQ ID NO: 4946 - DNA, 1621 bp, Artificial Sequence
  Description of Artificial Sequence: Synthetic polynucleotide
  modified_base (11)..(11): a, c, t, g, unknown or other
  modified_base (14)..(14): a, c, t, g, unknown or other
  modified_base (20)..(20): a, c, t, g, unknown or other
  modified_base (26)..(26): a, c, t, g, unknown or other
  modified_base (29)..(29): a, c, t, g, unknown or other
  modified_base (42)..(42): a, c, t, g, unknown or other
  modified_base (66)..(66): a, c, t, g, unknown or other
  modified_base (120)..(120): a, c, t, g, unknown or other
  modified_base (127)..(127): a, c, t, g, unknown or other
  modified_base (139)..(139): a, c, t, g, unknown or other
  modified_base (157)..(157): a, c, t, g, unknown or other
  modified_base (169)..(169): a, c, t, g, unknown or other
  modified_base (173)..(173): a, c, t, g, unknown or other
  modified_base (220)..(220): a, c, t, g, unknown or other
  modified_base (226)..(226): a, c, t, g, unknown or other
  modified_base (234)..(234): a, c, t, g, unknown or other
  modified_base (250)..(250): a, c, t, g, unknown or other
  modified_base (261)..(261): a, c, t, g, unknown or other
  modified_base (335)..(335): a, c, t, g, unknown or other
  modified_base (345)..(345): a, c, t, g, unknown or other
  modified_base (347)..(347): a, c, t, g, unknown or other
  modified_base (365)..(365): a, c, t, g, unknown or other
  modified_base (401)..(401): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (428)..(428): a, c, t, g, unknown or other
  modified_base (440)..(440): a, c, t, g, unknown or other
  modified_base (464)..(464): a, c, t, g, unknown or other
  modified_base (473)..(473): a, c, t, g, unknown or other
  modified_base (482)..(482): a, c, t, g, unknown or other
  modified_base (507)..(507): a, c, t, g, unknown or other
  modified_base (518)..(518): a, c, t, g, unknown or other
  modified_base (532)..(532): a, c, t, g, unknown or other
  modified_base (555)..(555): a, c, t, g, unknown or other
  modified_base (595)..(595): a, c, t, g, unknown or other
  modified_base (640)..(640): a, c, t, g, unknown or other
  modified_base (647)..(647): a, c, t, g, unknown or other
  modified_base (690)..(690): a, c, t, g, unknown or other
  modified_base (712)..(712): a, c, t, g, unknown or other
  modified_base (732)..(732): a, c, t, g, unknown or other
  modified_base (765)..(765): a, c, t, g, unknown or other
  modified_base (801)..(801): a, c, t, g, unknown or other
  modified_base (817)..(817): a, c, t, g, unknown or other
  modified_base (826)..(826): a, c, t, g, unknown or other
  modified_base (858)..(858): a, c, t, g, unknown or other
  modified_base (885)..(885): a, c, t, g, unknown or other
  modified_base (906)..(906): a, c, t, g, unknown or other
  modified_base (919)..(919): a, c, t, g, unknown or other
  modified_base (963)..(963): a, c, t, g, unknown or other
  modified_base (983)..(983): a, c, t, g, unknown or other
  modified_base (989)..(989): a, c, t, g, unknown or other
  modified_base (1028)..(1028): a, c, t, g, unknown or other
  modified_base (1038)..(1038): a, c, t, g, unknown or other
  modified_base (1105)..(1105): a, c, t, g, unknown or other
  modified_base (1107)..(1107): a, c, t, g, unknown or other
  modified_base (1123)..(1123): a, c, t, g, unknown or other
  modified_base (1151)..(1151): a, c, t, g, unknown or other
  modified_base (1156)..(1156): a, c, t, g, unknown or other
  modified_base (1158)..(1158): a, c, t, g, unknown or other
  modified_base (1166)..(1166): a, c, t, g, unknown or other
  modified_base (1207)..(1207): a, c, t, g, unknown or other
  modified_base (1221)..(1221): a, c, t, g, unknown or other
  modified_base (1235)..(1235): a, c, t, g, unknown or other
  modified_base (1239)..(1239): a, c, t, g, unknown or other
  modified_base (1271)..(1271): a, c, t, g, unknown or other
  modified_base (1274)..(1274): a, c, t, g, unknown or other
  modified_base (1300)..(1300): a, c, t, g, unknown or other
  modified_base (1324)..(1324): a, c, t, g, unknown or other
  modified_base (1337)..(1337): a, c, t, g, unknown or other
  modified_base (1366)..(1366): a, c, t, g, unknown or other
  modified_base (1388)..(1388): a, c, t, g, unknown or other
  modified_base (1393)..(1393): a, c, t, g, unknown or other
  modified_base (1399)..(1399): a, c, t, g, unknown or other
  modified_base (1438)..(1438): a, c, t, g, unknown or other
  modified_base (1441)..(1441): a, c, t, g, unknown or other
  modified_base (1514)..(1514): a, c, t, g, unknown or other
  modified_base (1524)..(1524): a, c, t, g, unknown or other
  modified_base (1533)..(1533): a, c, t, g, unknown or other
  modified_base (1567)..(1567): a, c, t, g, unknown or other
  modified_base (1586)..(1586): a, c, t, g, unknown or other
  modified_base (1592)..(1592): a, c, t, g, unknown or other
  modified_base (1618)..(1618): a, c, t, g, unknown or other
gctctgctaanaantaacantcttgncangaccttaggaggncaacatcagccagcacccattttnatacaggtgactyggtggacctttgtttcccatcaagtccctttcytctagcanccaagcnccyctgcagccncccctgacacagcctggnagcaggtgcttncctncaagggaaacagccaggccctgtgccccatatgcaatgaacaaggcngggctntgcccctntcctgcaagcaatcancacaggccctnaagcatgagatttaattgcttgttcattattttagcttgcaggggctacaaggaagtatggcatttctgagcanaccatccgangnaaccctgggagctgtcanattaaaaaataacaacagaaaygagaaaggagcctntctttagccnaanggnttcaggtgccngtgactcaatgnagggcccccatcaaaacccatggnagcccctcnctgtttgtnctgcccttttcaattctgtctgagnggggakgagantgccacaaagagangwgaatttgaactcgcagccccngagtgcacsaatgycctttttctgcctgattgtatacttnaagtgcctgtaaagtcaataacttcccatggtttcacagcaaagncaaaagnttaaaaaagagacattgtccttttgaagatgtggaaagtaatnagtgagcaggctgaatcctctntgggtttaaaagcctgtgcnttctgctttaaggtgtcaaaattgccttaaatntttagctttgttataccctgctgctacacagataknatagaaccaggctgantctctcaanttyggagatcattttttctctctaaaaacttngttgaaatatatatgttagcacagacnttttcttracattttctgttnaaaatatagtatntttttcagatgcatcttaagagatcagaatagtcaaacagtagntctctttttgaaaaaaraanttgtanaccatcttcaagttttaagcacaaaggttacagctagtnctcctccccnattttatttccactgttggagcagatttgacctcgtctctctaaaggcagaaaacttcaacaaaggngngaggactatttaaagngatgaaaaagattctgaatgaagsattntgccntngatgaagnctgaaagaaatgcagtgcttaggaagtggataaaagtcaanagcaacaattcttngctttggatgaaancttnaaggtgcacttttccccagtgatrtgaaaaanaanaaaataaaaacaaccaaccagagacncgtaactcttytggttctgtggcntctgtacattcantgatagaaacttrctaaatcccaaagggnccctggcaaagcccaggctccntgatnggctgngagccctgccactgcaccaggagaaaaggagtcactagnctnggatggggaagagaaaagcctctttcctccctcccattccaaaagagaagaaaaaacctggacagccagatanaagcagcctngaaaaatcnctctagaggagaaaagacaggaagaatgtcatcnagaaagaaggccaggagangatgcnacaaaggtgcttttyctccctcctcnctt

SEQ ID NO: 4947 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  misc_feature (834)..(834): May or may not be present
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1410)..(1410): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaaagttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaaganagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4948 - DNA, 666 bp, Artificial Sequence
  Description of Artificial Sequence: Synthetic polynucleotide
  modified_base (39)..(39): a, c, t, g, unknown or other
  modified_base (45)..(45): a, c, t, g, unknown or other
  modified_base (48)..(48): a, c, t, g, unknown or other
  modified_base (62)..(62): a, c, t, g, unknown or other
  modified_base (70)..(70): a, c, t, g, unknown or other
  modified_base (84)..(84): a, c, t, g, unknown or other
  modified_base (89)..(89): a, c, t, g, unknown or other
  modified_base (108)..(108): a, c, t, g, unknown or other
  modified_base (113)..(113): a, c, t, g, unknown or other
  modified_base (130)..(130): a, c, t, g, unknown or other
  modified_base (140)..(140): a, c, t, g, unknown or other
  modified_base (162)..(162): a, c, t, g, unknown or other
  modified_base (165)..(165): a, c, t, g, unknown or other
  modified_base (169)..(169): a, c, t, g, unknown or other
  modified_base (193)..(193): a, c, t, g, unknown or other
  modified_base (197)..(197): a, c, t, g, unknown or other
  modified_base (224)..(224): a, c, t, g, unknown or other
  modified_base (226)..(226): a, c, t, g, unknown or other
  modified_base (230)..(230): a, c, t, g, unknown or other
  modified_base (235)..(235): a, c, t, g, unknown or other
  modified_base (245)..(245): a, c, t, g, unknown or other
  modified_base (250)..(250): a, c, t, g, unknown or other
  modified_base (252)..(252): a, c, t, g, unknown or other
  modified_base (266)..(266): a, c, t, g, unknown or other
  modified_base (278)..(278): a, c, t, g, unknown or other
  modified_base (291)..(291): a, c, t, g, unknown or other
  modified_base (305)..(305): a, c, t, g, unknown or other
  modified_base (322)..(322): a, c, t, g, unknown or other
  modified_base (352)..(352): a, c, t, g, unknown or other
  modified_base (363)..(363): a, c, t, g, unknown or other
  modified_base (367)..(367): a, c, t, g, unknown or other
  misc_feature (395)..(396): This region may encompass 'ca' or 'gg'
  modified_base (430)..(430): a, c, t, g, unknown or other
  modified_base (445)..(445): a, c, t, g, unknown or other
  modified_base (461)..(461): a, c, t, g, unknown or other
  modified_base (478)..(478): a, c, t, g, unknown or other
  modified_base (487)..(487): a, c, t, g, unknown or other
  modified_base (489)..(489): a, c, t, g, unknown or other
  modified_base (494)..(494): a, c, t, g, unknown or other
  modified_base (511)..(511): a, c, t, g, unknown or other
  modified_base (516)..(516): a, c, t, g, unknown or other
  modified_base (518)..(518): a, c, t, g, unknown or other
  modified_base (520)..(520): a, c, t, g, unknown or other
  modified_base (540)..(540): a, c, t, g, unknown or other
  modified_base (560)..(560): a, c, t, g, unknown or other
  modified_base (562)..(562): a, c, t, g, unknown or other
  modified_base (598)..(598): a, c, t, g, unknown or other
  modified_base (608)..(608): a, c, t, g, unknown or other
  modified_base (610)..(610): a, c, t, g, unknown or other
  modified_base (616)..(616): a, c, t, g, unknown or other
  modified_base (622)..(622): a, c, t, g, unknown or other
  modified_base (641)..(641): a, c, t, g, unknown or other
  modified_base (643)..(643): a, c, t, g, unknown or other
  modified_base (645)..(645): a, c, t, g, unknown or other
caggcagcacctcacrgaatccaggctcacagaaagtcngtttcnatnagaatttaaaacanccctcttntgctgcaactcttnaggcnactgacaaggtgacaggancacantttgtacaggatacaancatattcccnatgggtggacaaaacgaccccntancccntctacaccaaggagctgcacctgngccntgtgtagccagatgcaattttctattntngganaatcnactttaagtngttcntnagcaaattcttccnaagtactgtttnctttcctcaattnctggcctagcaagntagaaagaaaacaaaangaatgtaaaatgttcttggttgactttacncttaattactnaaangcaaacagagaaaattaaaatcaaacasrtgcaaaaaattcttctagagccttgcacacaatnccagttcttgaaatnttcataaagcaaagcnaatgaaataaacaaagncrtggctgnanggatntgcattgtactrtgctnatggncnanttgctcactgcatctctcgntccacygccrccrggctcrncnccagaagcctgttcctgagctgattggggttctggnccaggggtcncnaggagngaggcncaagctcaggaggacaaanancnaccacctggaaagtggcaaaa

SEQ ID NO: 4949 - DNA, 536 bp, Artificial Sequence
  Description of Artificial Sequence: Synthetic polynucleotide
  modified_base (20)..(20): a, c, t, g, unknown or other
  modified_base (26)..(26): a, c, t, g, unknown or other
  modified_base (42)..(42): a, c, t, g, unknown or other
  modified_base (103)..(103): a, c, t, g, unknown or other
  modified_base (129)..(129): a, c, t, g, unknown or other
  modified_base (140)..(140): a, c, t, g, unknown or other
  modified_base (163)..(163): a, c, t, g, unknown or other
  modified_base (170)..(170): a, c, t, g, unknown or other
  modified_base (195)..(195): a, c, t, g, unknown or other
  modified_base (285)..(285): a, c, t, g, unknown or other
  modified_base (298)..(298): a, c, t, g, unknown or other
  modified_base (305)..(305): a, c, t, g, unknown or other
  modified_base (313)..(313): a, c, t, g, unknown or other
  modified_base (335)..(335): a, c, t, g, unknown or other
  modified_base (365)..(365): a, c, t, g, unknown or other
  modified_base (468)..(468): a, c, t, g, unknown or other
  modified_base (477)..(477): a, c, t, g, unknown or other
atcaaagccattagcctaangacacnaaaaagctcagaaaantggtgaaaaattatcaggtgaagatccaaaagaagattaaagtgcagaaaagtgaatccanctgagakggtaatttttcccttgggnattagctgctnaggacctggccagcacttttganggcttcncagggataaagacaccaaaggtggnatctaggcccacattttaagcttggggccctaaagactacattctgaatcaacctcaagtakcactgccctcacacwgactgcagcccanttcaaagcagctnaatctcngaaattgngttaaggtgttctaaggctacnagcaatttagaaattttgtttttcagcctntttcatgttcctttcagctaagttttccttctactggacacaggtggaatctcaatgagaaaagatattcatgagactattaaggaaatataaaatgaygtancatgtgtgntgcaaaagggaattttatttattatgctaaggaatttagaggaaaacattgcagctttg

SEQ ID NO: 4950 - DNA, 151 bp, Artificial Sequence
  Description of Artificial Sequence: Synthetic polynucleotide
  modified_base (13)..(13): a, c, t, g, unknown or other
  modified_base (86)..(86): a, c, t, g, unknown or other
  modified_base (113)..(113): a, c, t, g, unknown or other
  modified_base (137)..(137): a, c, t, g, unknown or other
atctaatccaacntttttatttccttcttgakgtactgcataaagtttagagattacttcattggccttaactccagagttttctngccagtgcrcggggaatagcttcaaangcctcagcaaacttcttaatagcntactgttcaagtcc

SEQ ID NO: 4951 - DNA, 957 bp, Artificial Sequence
  Description of Artificial Sequence: Synthetic polynucleotide
  modified_base (41)..(41): a, c, t, g, unknown or other
  modified_base (50)..(50): a, c, t, g, unknown or other
  modified_base (53)..(53): a, c, t, g, unknown or other
  modified_base (55)..(55): a, c, t, g, unknown or other
  modified_base (65)..(65): a, c, t, g, unknown or other
  modified_base (70)..(70): a, c, t, g, unknown or other
  modified_base (74)..(74): a, c, t, g, unknown or other
  modified_base (118)..(118): a, c, t, g, unknown or other
  modified_base (124)..(124): a, c, t, g, unknown or other
  modified_base (147)..(147): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (176)..(176): a, c, t, g, unknown or other
  modified_base (210)..(210): a, c, t, g, unknown or other
  modified_base (213)..(213): a, c, t, g, unknown or other
  modified_base (221)..(221): a, c, t, g, unknown or other
  modified_base (243)..(243): a, c, t, g, unknown or other
  modified_base (270)..(270): a, c, t, g, unknown or other
  modified_base (279)..(279): a, c, t, g, unknown or other
  modified_base (294)..(294): a, c, t, g, unknown or other
  modified_base (327)..(327): a, c, t, g, unknown or other
  modified_base (348)..(348): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
  modified_base (390)..(390): a, c, t, g, unknown or other
  modified_base (396)..(396): a, c, t, g, unknown or other
  modified_base (402)..(402): a, c, t, g, unknown or other
  modified_base (406)..(406): a, c, t, g, unknown or other
  modified_base (412)..(412): a, c, t, g, unknown or other
  modified_base (475)..(475): a, c, t, g, unknown or other
  modified_base (485)..(485): a, c, t, g, unknown or other
  modified_base (489)..(489): a, c, t, g, unknown or other
  modified_base (505)..(505): a, c, t, g, unknown or other
  modified_base (542)..(542): a, c, t, g, unknown or other
  modified_base (548)..(548): a, c, t, g, unknown or other
  modified_base (557)..(557): a, c, t, g, unknown or other
  modified_base (566)..(566): a, c, t, g, unknown or other
  modified_base (582)..(582): a, c, t, g, unknown or other
  modified_base (585)..(585): a, c, t, g, unknown or other
  modified_base (600)..(600): a, c, t, g, unknown or other
  modified_base (638)..(638): a, c, t, g, unknown or other
  modified_base (648)..(648): a, c, t, g, unknown or other
  modified_base (659)..(659): a, c, t, g, unknown or other
  modified_base (689)..(689): a, c, t, g, unknown or other
  modified_base (691)..(691): a, c, t, g, unknown or other
  modified_base (699)..(699): a, c, t, g, unknown or other
  modified_base (705)..(705): a, c, t, g, unknown or other
  modified_base (726)..(726): a, c, t, g, unknown or other
  modified_base (746)..(746): a, c, t, g, unknown or other
  modified_base (759)..(759): a, c, t, g, unknown or other
  modified_base (766)..(766): a, c, t, g, unknown or other
  modified_base (839)..(839): a, c, t, g, unknown or other
  modified_base (856)..(856): a, c, t, g, unknown or other
  modified_base (875)..(875): a, c, t, g, unknown or other
  modified_base (883)..(883): a, c, t, g, unknown or other
  modified_base (895)..(895): a, c, t, g, unknown or other
  modified_base (897)..(897): a, c, t, g, unknown or other
  modified_base (900)..(900): a, c, t, g, unknown or other
  modified_base (904)..(904): a, c, t, g, unknown or other
  modified_base (907)..(907): a, c, t, g, unknown or other
  modified_base (915)..(915): a, c, t, g, unknown or other
  modified_base (937)..(937): a, c, t, g, unknown or other
  modified_base (940)..(940): a, c, t, g, unknown or other
gatggcaagggccaaaggtggggccagaagttctcgagctnttagatggnagntnagcttcatanccagncagnagggcaarggtacagagaatccacagaatctgaaggctcctacnactttntctacartgttcttcatgtcatntccactttgckntanaatattgcaatnantgctttaaatgaacaaatttctaagatatcstcntcntatccatncattacactgtaaaaaatgaanaaatcctttattatacaygcatcttanacagaaatnaaatgtaattcatcncacatgctgtcagctaattaaagtatttgtacnacagattcctcagccttttananaancttggaggagcnctggggtcttattccaggagaaaancaaatnaatctncatntttccncttatttaatttatgccacaataacagtagcttcagtgcagagctgcagcttcaagctttacntttaccctgnaagntaaatgtgcaccttcngaaaactgcctgcaagtaaaaagaaggaaattacacnttaaanaaatttttnaattgggangaactggtttttcctnctnctgctacattcaganttctgtcttaagtatcattccccctcaccttgctattnacttttctcnctgatctcagnccagtgggaactgagatactggagaaagtntnttttttcncctagntttacagtgtgacagaagaangtttaagtgataggcaaatnaaggaaatgcasntcctcantattcagaactaatttaccaggttcttggcatgctgagaaactcactaggtttgtggtctttttgtgaataanagcacattttcacctangactggcaggtggtcacanctcagctnagagagtcccantnganagcncantctgctgncatgtaactaagtgattttttnccnctgaaagtttatgtact

SEQ ID NO: 4952 - DNA, 127 bp, Artificial Sequence
  Description of Artificial Sequence: Synthetic polynucleotide
  modified_base (21)..(21): a, c, t, g, unknown or other
  modified_base (58)..(58): a, c, t, g, unknown or other
  modified_base (85)..(85): a, c, t, g, unknown or other
  modified_base (91)..(91): a, c, t, g, unknown or other
  modified_base (118)..(118): a, c, t, g, unknown or other
ggattgaagatttcctccacnaccagctgaaaawattmtttggaaacacctccctcanccttgttctccttcaaattccacatanaactgncttcaagtctgcaggattttccatagngatcatctc

SEQ ID NO: 4953 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (531)..(531): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagnaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagsctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 4954 - DNA, 175 bp, Artificial Sequence
  Description of Artificial Sequence: Synthetic polynucleotide
  modified_base (12)..(12): a, c, t, g, unknown or other
  modified_base (17)..(17): a, c, t, g, unknown or other
  modified_base (21)..(21): a, c, t, g, unknown or other
  modified_base (51)..(51): a, c, t, g, unknown or other
  modified_base (78)..(78): a, c, t, g, unknown or other
  modified_base (124)..(124): a, c, t, g, unknown or other
  modified_base (139)..(139): a, c, t, g, unknown or other
  modified_base (142)..(142): a, c, t, g, unknown or other
  modified_base (145)..(145): a, c, t, g, unknown or other
  modified_base (156)..(156): a, c, t, g, unknown or other
  modified_base (168)..(168): a, c, t, g, unknown or other
gtaaaaattgcnctggnagantgttttatagaaactctagaaaaacccagngaaatatgcctactccacaaytgtatntgctgttctaatgaccagataatggaatccccaaatacagtagccntttaccattaaaagnatnagntgttttggaanagagagagtgangagaagc

SEQ ID NO: 4955 - DNA, 640 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (44)..(44): a, c, t, g, unknown or other
  modified_base (49)..(49): a, c, t, g, unknown or other
  modified_base (63)..(63): a, c, t, g, unknown or other
  modified_base (84)..(84): a, c, t, g, unknown or other
  modified_base (99)..(99): a, c, t, g, unknown or other
  modified_base (153)..(153): a, c, t, g, unknown or other
  modified_base (184)..(184): a, c, t, g, unknown or other
  modified_base (196)..(196): a, c, t, g, unknown or other
  modified_base (215)..(215): a, c, t, g, unknown or other
  modified_base (231)..(231): a, c, t, g, unknown or other
  modified_base (235)..(235): a, c, t, g, unknown or other
  modified_base (245)..(245): a, c, t, g, unknown or other
  modified_base (248)..(248): a, c, t, g, unknown or other
  modified_base (333)..(333): a, c, t, g, unknown or other
  modified_base (347)..(347): a, c, t, g, unknown or other
  modified_base (354)..(354): a, c, t, g, unknown or other
  modified_base (372)..(372): a, c, t, g, unknown or other
  modified_base (376)..(376): a, c, t, g, unknown or other
  modified_base (382)..(382): a, c, t, g, unknown or other
  modified_base (387)..(387): a, c, t, g, unknown or other
  modified_base (432)..(432): a, c, t, g, unknown or other
  modified_base (445)..(445): a, c, t, g, unknown or other
  modified_base (451)..(451): a, c, t, g, unknown or other
  modified_base (460)..(460): a, c, t, g, unknown or other
  modified_base (481)..(481): a, c, t, g, unknown or other
  modified_base (490)..(490): a, c, t, g, unknown or other
  modified_base (506)..(506): a, c, t, g, unknown or other
  modified_base (511)..(511): a, c, t, g, unknown or other
  modified_base (522)..(543): a, c, t, g, unknown or other
  modified_base (548)..(548): a, c, t, g, unknown or other
  modified_base (558)..(558): a, c, t, g, unknown or other
  modified_base (591)..(591): a, c, t, g, unknown or other
  modified_base (613)..(613): a, c, t, g, unknown or other
  modified_base (618)..(618): a, c, t, g, unknown or other
  modified_base (632)..(632): a, c, t, g, unknown or other
cataacttaaagtngatttattttcagtgccttttnaaagttancaaynatctttggatactntagttgccctgagttcaactncatgttttataaaanaggcacartcttcctttatgggaggaggagtttctttctatgtctttggttatnagaattagaaaaactgccttgatcagcatanattaaatttttnaaagttaastttttcaycncttgtgagactaattntatntattcttcantgntgatgattatgatgtgacttcaatttacccttcctaatgtgattgtaamttttcatgtaatgaaagaagaggcacaaccaagatnactgcacagcattngtaacangtagaaaatatatttcanattntgagangaganaaactcttagctctcaaggtcacagaatgctgacagttaattggncttttgagaaatncttganagaagactnaaaattgcattcaagtattantcaagattntgtataatagcaatanaaaancacaatgtggnnnnnnnnnnnnnnnnnnnnnngtttnctacaaatcnttgctacatacaagaaagtgtgatgtagactantaatttatgcttrgaattgctnytttnttaactacctgtcnataaaggt

SEQ ID NO: 4956 - DNA, 279 bp, Artificial Sequence
  Description of Artificial Sequence: Synthetic polynucleotide
  modified_base (32)..(32): a, c, t, g, unknown or other
  modified_base (82)..(82): a, c, t, g, unknown or other
  modified_base (101)..(101): a, c, t, g, unknown or other
  modified_base (190)..(190): a, c, t, g, unknown or other
  modified_base (256)..(256): a, c, t, g, unknown or other
  modified_base (266)..(266): a, c, t, g, unknown or other
tttaactgattatctttttctaagccacatgntaagatgttcttgtctgtctttcagttaggactttatttttacttttaanttcagagcttcttgatggntgttctttctaaataattattatttagcaactgactgtcataagagatycaaaatacatcaaatatctaacasaaaatrtaaaatatgnagtaatcttagccctcaaggaaacccagatttcccaattctgagtatattgttcaagttccttttncaggacagcncaaggttctgtca

SEQ ID NO: 4957 - DNA, 664 bp, Artificial Sequence
  Description of Artificial Sequence: Synthetic polynucleotide
  modified_base (1)..(1): a, c, t, g, unknown or other
  modified_base (11)..(11): a, c, t, g, unknown or other
  modified_base (28)..(28): a, c, t, g, unknown or other
  modified_base (74)..(74): a, c, t, g, unknown or other
  modified_base (93)..(93): a, c, t, g, unknown or other
  modified_base (97)..(97): a, c, t, g, unknown or other
  modified_base (132)..(132): a, c, t, g, unknown or other
  modified_base (134)..(134): a, c, t, g, unknown or other
  modified_base (156)..(156): a, c, t, g, unknown or other
  modified_base (162)..(162): a, c, t, g, unknown or other
  modified_base (207)..(207): a, c, t, g, unknown or other
  modified_base (223)..(223): a, c, t, g, unknown or other
  modified_base (227)..(227): a, c, t, g, unknown or other
  modified_base (243)..(243): a, c, t, g, unknown or other
  modified_base (252)..(252): a, c, t, g, unknown or other
  modified_base (283)..(283): a, c, t, g, unknown or other
  modified_base (293)..(293): a, c, t, g, unknown or other
  modified_base (316)..(316): a, c, t, g, unknown or other
  modified_base (335)..(335): a, c, t, g, unknown or other
  modified_base (369)..(369): a, c, t, g, unknown or other
  modified_base (393)..(393): a, c, t, g, unknown or other
  modified_base (410)..(410): a, c, t, g, unknown or other
  modified_base (444)..(444): a, c, t, g, unknown or other
  modified_base (453)..(453): a, c, t, g, unknown or other
  modified_base (500)..(500): a, c, t, g, unknown or other
  modified_base (522)..(522): a, c, t, g, unknown or other
  modified_base (557)..(557): a, c, t, g, unknown or other
  modified_base (577)..(577): a, c, t, g, unknown or other
  modified_base (615)..(615): a, c, t, g, unknown or other
  modified_base (625)..(625): a, c, t, g, unknown or other
  modified_base (660)..(660): a, c, t, g, unknown or other
ncagartgtgncttgatctgactccaanctgatctagaattgaaggctgttaggaagactrttctcacacatanttgtactttgaaaggtggntctnaaattgtctggaggcccatggccaatatcaacagngntttgtgaggaaagagatccccntagtancagtgagcattgtcatgcacagcatgaatgctcaataaatgtacnaaattgaactaaaatntttnacaaatatgaggatanactaacatnaaatcaaaaacaaaaaaaagtaaaatgatgntgcgagcttntcagggcataattaatagaaagntatttcatmttatcttctnaaggctaaaggaagcattttgggagttaactacnaggataagtgattctaggaaatgngatacagaaaaggggtntgtgtycctgagacttctcccttgtctggggagnccrtttctncttccatgttgaatatcstcaccsaaaaagtgagacaaagtttgctntagtccagcaatagacaggatngtaccagragctgaaattatttttatagkaatagnaaagaaatttctgcaataanacttaaaaatatcaattaaaacaaagacaaatatacangatgaaacanaacagcatccaatcaatgggataggagattaaaantcat

SEQ ID NO: 4958 - DNA, 667 bp, Artificial Sequence
  Description of Artificial Sequence: Synthetic polynucleotide
  modified_base (14)..(14): a, c, t, g, unknown or other
  modified_base (36)..(36): a, c, t, g, unknown or other
  modified_base (60)..(60): a, c, t, g, unknown or other
  modified_base (85)..(85): a, c, t, g, unknown or other
  modified_base (110)..(110): a, c, t, g, unknown or other
  modified_base (124)..(124): a, c, t, g, unknown or other
  modified_base (133)..(133): a, c, t, g, unknown or other
  modified_base (157)..(157): a, c, t, g, unknown or other
  modified_base (185)..(185): a, c, t, g, unknown or other
  modified_base (204)..(204): a, c, t, g, unknown or other
  modified_base (209)..(209): a, c, t, g, unknown or other
  modified_base (219)..(219): a, c, t, g, unknown or other
  modified_base (261)..(261): a, c, t, g, unknown or other
  modified_base (270)..(270): a, c, t, g, unknown or other
  modified_base (297)..(297): a, c, t, g, unknown or other
  modified_base (315)..(315): a, c, t, g, unknown or other
  modified_base (320)..(320): a, c, t, g, unknown or other
  modified_base (324)..(324): a, c, t, g, unknown or other
  modified_base (355)..(355): a, c, t, g, unknown or other
  modified_base (383)..(383): a, c, t, g, unknown or other
  modified_base (395)..(395): a, c, t, g, unknown or other
  modified_base (411)..(411): a, c, t, g, unknown or other
  modified_base (432)..(432): a, c, t, g, unknown or other
  modified_base (452)..(452): a, c, t, g, unknown or other
  modified_base (470)..(470): a, c, t, g, unknown or other
  modified_base (475)..(475): a, c, t, g, unknown or other
  modified_base (517)..(517): a, c, t, g, unknown or other
  modified_base (532)..(532): a, c, t, g, unknown or other
  modified_base (546)..(546): a, c, t, g, unknown or other
  modified_base (578)..(578): a, c, t, g, unknown or other
  modified_base (613)..(613): a, c, t, g, unknown or other
  modified_base (653)..(653): a, c, t, g, unknown or other
  modified_base (656)..(656): a, c, t, g, unknown or other
cccctcagcatggncctctgaaccagcctgacctgncctgcaggctccaacacaccagcnggccctgccagaaccttggcaaggncrggatgcatgaattccagagccangacagcccgtcaanagggccttnttatttccccttcccagggccacnactgcacagaataatgatttttgacagngaagccaaatgaatactangggangtgaccactngtactcaggagtacttatgagaaaaagaataagaacaaaaantgtttaagntacctctctattgtataatatatactnacaacaaataaaacattntgttnaacnttagaaattacattttaaaacaagattctcnttaaaaacacacacaaaccacacacacnaatgacaacaanaataaaaacactgtangaatactgcaggaagggttcnaggtaatccacatcaacccnggtatcaggttcttgagnccagnccatggctaagygcgaacacactctgtattagtgtctcaagncagggggccctgacnccagcaactttgangttaaactgttatgtacattatatctacatgngaatacagtattttaaattaggaggcaagcacacntataaaggtgttactctaccaaatatcaggagatggttgnggncagagaacagt

SEQ ID NO: 4959 - DNA, 1941 bp, Artificial Sequence
  Description of Artificial Sequence: Synthetic polynucleotide
  modified_base (11)..(11): a, c, t, g, unknown or other
  modified_base (113)..(113): a, c, t, g, unknown or other
  modified_base (117)..(117): a, c, t, g, unknown or other
  modified_base (192)..(192): a, c, t, g, unknown or other
  modified_base (201)..(201): a, c, t, g, unknown or other
  modified_base (236)..(236): a, c, t, g, unknown or other
  modified_base (258)..(258): a, c, t, g, unknown or other
  modified_base (386)..(386): a, c, t, g, unknown or other
  modified_base (597)..(597): a, c, t, g, unknown or other
  modified_base (641)..(641): a, c, t, g, unknown or other
  modified_base (665)..(665): a, c, t, g, unknown or other
  modified_base (690)..(690): a, c, t, g, unknown or other
  modified_base (733)..(733): a, c, t, g, unknown or other
  modified_base (762)..(762): a, c, t, g, unknown or other
  modified_base (834)..(834): a, c, t, g, unknown or other
  modified_base (1005)..(1005): a, c, t, g, unknown or other
  modified_base (1061)..(1061): a, c, t, g, unknown or other
  modified_base (1102)..(1102): a, c, t, g, unknown or other
  modified_base (1147)..(1147): a, c, t, g, unknown or other
  modified_base (1204)..(1204): a, c, t, g, unknown or other
  modified_base (1215)..(1215): a, c, t, g, unknown or other
  modified_base (1227)..(1227): a, c, t, g, unknown or other
  modified_base (1268)..(1268): a, c, t, g, unknown or other
  modified_base (1287)..(1287): a, c, t, g, unknown or other
  modified_base (1300)..(1300): a, c, t, g, unknown or other
  modified_base (1311)..(1311): a, c, t, g, unknown or other
  modified_base (1324)..(1324): a, c, t, g, unknown or other
  modified_base (1388)..(1388): a, c, t, g, unknown or other
  modified_base (1415)..(1415): a, c, t, g, unknown or other
  modified_base (1418)..(1418): a, c, t, g, unknown or other
  modified_base (1479)..(1479): a, c, t, g, unknown or other
  modified_base (1495)..(1495): a, c, t, g, unknown or other
  modified_base (1501)..(1501): a, c, t, g, unknown or other
  modified_base (1511)..(1511): a, c, t, g, unknown or other
  modified_base (1535)..(1535): a, c, t, g, unknown or other
  modified_base (1568)..(1568): a, c, t, g, unknown or other
  modified_base (1619)..(1619): a, c, t, g, unknown or other
  modified_base (1625)..(1625): a, c, t, g, unknown or other
  modified_base (1671)..(1671): a, c, t, g, unknown or other
  modified_base (1673)..(1673): a, c, t, g, unknown or other
  modified_base (1688)..(1688): a, c, t, g, unknown or other
  modified_base (1749)..(1749): a, c, t, g, unknown or other
  modified_base (1866)..(1866): a, c, t, g, unknown or other
  modified_base (1908)..(1908): a, c, t, g, unknown or other
  modified_base (1940)..(1940): a, c, t, g, unknown or other
tagtgctcccngtgaaccatcatctctcttaccacaccattagtgcctctcattgcatcaccacctaggacgttttattgtttgtaattttatttagtggtaggcagtggggncaanagatacctaaattacttctctcaatatttccattggtttttctctgagatttggctaacatacatcttaaattcnttttagtcnatagtttaatattatgttggcagtagacagttctnaaaaatatgagacagaaagtcntactctaagataaaaataatgttgaataattttatttcagaartaagaattttctggtaattatgtattattcatcataatttaaaagttagctttgatgccaaaattttatctcacttyraaaagancagactttgtgtaattttatagttctgaagaaaaattatcattatacttagatattctgacaaattatctagtatattccttagaccttaaaactaaaatatagctataattaycaaagtttaaattatccttcagatcttagctttgatcaagaayttacacaaaccaytcagaaaaggttasctgcccctgtaatgtatgggctcttcncctacaatccagttgcagcactttttacactgtaattaaagatnatgcccctttctgtycactgctangttaagcaccctgttcagcacttantgaactttttttctgctgagcatctattatctttttttgcatntgtgtatgaattcatcaataaacaatganctatgatatgaaacacactaatgcctccaccagtaataacctagaatcttgaatttcttcacttaaaaaaangttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaaccnwagaaaaataatttaacccaaaaayagtttaatatyagcattaagtttctttctgntttgaggccaatttctcaggtaaactgtccaagctagtaanttatacaaggacygtgggatggggaaatgagaacaataatgacangtggaggataggctatttagaagcaactttctattaaaagtcaaattctattgctgnttgttaaatangatcaaagtcantcttacagcccaagagtactatcagttttaaaagcagccanagaaggtttggtgtctcanggcaaactttacncctccaaatcntaaatcaaccccngccccacactcttccaacatrctatgtaaaaccaaggttgcttataaacagtaagtctaatttngaaaagtgaaagcaatgaagasagagngcnraaaggaagataactggtaaaagaaacaaaagagtttacagtttgtctttttggtaaatanaatcacttgtatacantggagntacagcagcnaacacttcactmtttagggaattnttaaaagaagtctcatatataaaattgagttcnatatcaagtagaacaagaaattagaccyaatcctgttttgataactacagnaacagntattatcagctttagccttcaataatttcacaatacaaattaggtngnctagcaacagtaatntctccaaaaataccacaacaagcacaagtgaactaaaagraaagtctggtacttctaatyngctgtgttgttagcttgstgttccaaaggggtaggtattttttaggtttaacactatggttctctggctacttttaaaactgaaagtactcttcttataatataaagtaaacttctnataatttgtccaagagatatcaaaatacagtacctatgtttncatttatgaaattttcttgaaatatttactgna

SEQ ID NO: 4960 - DNA, 3427 bp, Artificial Sequence
  Description of Artificial Sequence: Synthetic polynucleotide
  modified_base (13)..(13): a, c, t, g, unknown or other
  modified_base (87)..(87): a, c, t, g, unknown or other
  modified_base (247)..(247): a, c, t, g, unknown or other
  modified_base (249)..(249): a, c, t, g, unknown or other
  modified_base (399)..(399): a, c, t, g, unknown or other
  modified_base (454)..(454): a, c, t, g, unknown or other
  modified_base (486)..(486): a, c, t, g, unknown or other
  modified_base (560)..(560): a, c, t, g, unknown or other
  modified_base (605)..(605): a, c, t, g, unknown or other
  modified_base (683)..(683): a, c, t, g, unknown or other
  modified_base (737)..(760): a, c, t, g, unknown or other
  modified_base (819)..(819): a, c, t, g, unknown or other
  modified_base (910)..(910): a, c, t, g, unknown or other
  modified_base (976)..(976): a, c, t, g, unknown or other
  modified_base (1061)..(1061): a, c, t, g, unknown or other
  modified_base (1087)..(1087): a, c, t, g, unknown or other
  modified_base (1175)..(1175): a, c, t, g, unknown or other
  modified_base (1234)..(1234): a, c, t, g, unknown or other
  modified_base (1241)..(1241): a, c, t, g, unknown or other
  modified_base (1284)..(1284): a, c, t, g, unknown or other
  modified_base (1289)..(1289): a, c, t, g, unknown or other
  modified_base (1322)..(1322): a, c, t, g, unknown or other
  modified_base (1325)..(1325): a, c, t, g, unknown or other
  modified_base (1360)..(1360): a, c, t, g, unknown or other
  modified_base (1369)..(1369): a, c, t, g, unknown or other
  modified_base (1422)..(1422): a, c, t, g, unknown or other
  modified_base (1505)..(1505): a, c, t, g, unknown or other
  modified_base (1516)..(1516): a, c, t, g, unknown or other
  modified_base (1642)..(1642): a, c, t, g, unknown or other
  modified_base (1699)..(1699): a, c, t, g, unknown or other
  modified_base (1804)..(1804): a, c, t, g, unknown or other
  modified_base (1808)..(1808): a, c, t, g, unknown or other
  modified_base (1839)..(1839): a, c, t, g, unknown or other
  modified_base (1854)..(1854): a, c, t, g, unknown or other
  modified_base (1884)..(1884): a, c, t, g, unknown or other
  modified_base (1892)..(1892): a, c, t, g, unknown or other
  modified_base (1995)..(1995): a, c, t, g, unknown or other
  modified_base (2046)..(2046): a, c, t, g, unknown or other
  modified_base (2103)..(2103): a, c, t, g, unknown or other
  modified_base (2158)..(2158): a, c, t, g, unknown or other
  modified_base (2286)..(2286): a, c, t, g, unknown or other
  modified_base (2304)..(2304): a, c, t, g, unknown or other
  modified_base (2318)..(2318): a, c, t, g, unknown or other
  modified_base (2356)..(2356): a, c, t, g, unknown or other
  modified_base (2432)..(2432): a, c, t, g, unknown or other
  modified_base (2463)..(2463): a, c, t, g, unknown or other
  modified_base (2490)..(2490): a, c, t, g, unknown or other
  modified_base (2493)..(2493): a, c, t, g, unknown or other
  modified_base (2587)..(2587): a, c, t, g, unknown or other
  modified_base (2648)..(2648): a, c, t, g, unknown or other
  modified_base (2835)..(2835): a, c, t, g, unknown or other
  modified_base (2915)..(2915): a, c, t, g, unknown or other
  modified_base (2933)..(2933): a, c, t, g, unknown or other
  modified_base (2956)..(2956): a, c, t, g, unknown or other
  modified_base (2958)..(2958): a, c, t, g, unknown or other
  modified_base (2970)..(2970): a, c, t, g, unknown or other
  modified_base (3006)..(3006): a, c, t, g, unknown or other
  modified_base (3028)..(3028): a, c, t, g, unknown or other
  modified_base (3102)..(3102): a, c, t, g, unknown or other
  modified_base (3383)..(3383): a, c, t, g, unknown or other
  modified_base (3410)..(3410): a, c, t, g, unknown or other
aagatattattangatggggacatgatttgtaaagttcaaggcaaragatttgtgtacaagtttgtctgtgacttgaagactcttantggatacagtgcagcggagttgaaccgtttggtcacagaatgtgaacagaagaarcttgcaaagatgcagctccatggaattgcccagccagtcacagcagtagctctgkctactgcttctctgcaaacggaaaaggataattgagccccaggacattcngngactccaaagtctttcttaaaatgtttagagcaagtatagctcttacctttattactgratttgaatcttcttttatttctaggctgtacagtctgatgcatgatttttttataaatatttcatactcttgtgaatttggatctttttantttgagcatatattttagaatatgtgtrtgttaaaggatctccacaatgtctgcngtgtgaaggcaggttcattgtggaatagtttnaacagtcaggaargctaaactggtcagtattaatgtgtagccctaccaaaaatagccagtagtatctgaaaatnaaaaawaaatgaagtatctctaggaaacagtctggcttaactatntttgaaaatataactgtttcccctctctgctgctttagatgttgctttacatagaaccagaaaatggaatttctcagntaaagcatgtgtgcctgtttcatctaatcaagcagagctaaaatgttcataccnnnnnnnnnnnnnnnnnnnnnnnnctaaactaagagtatcaggttatttatatatttgcaagcaaaggacagtaagaagttgnctggcaaaagagcagtgctgaaggaggagatccaggtttaaatctggcttattaactcaagccaattttaaggattttctgtatagattantcatgtcagaccaagaatttaaattattttgagagaggcatttaattctaataaaccagctgttanaaaaattataaaatgatctctgtttttcctgtcagagatttaaaaaactgaaaaggtatacctcaacycaaaaataaaggtttgntttggtttgttatggcttcctttttnaaaaaattaccctgtagtgccagtttattatgcaaagcagcttatattcctttgtttctgataaaatgaagactttaaatcagtcagnagtactttacctttcaaggcattagtaaattacttgcaaatagttttaaaaggaaaatncgacctntgttataggcagtcttctctttaagacaatacttttccacttnttttnccttttccatattatatatgtgtattcatatanctntatacatattcagttgatcattttataaacatatngaaggcatnaagakatacagaagaaaaattattaaacaactcattttaagattcaaattaantaattcctgcatatatgacattccttacataagcgaacactaaacaaaaatggctagaaatgtctttttctttcttttctctntttgttgtttnaaggtattaagcacgaattattacatgagactggcagatagctattaatcctcttacagatttgagaaagttgattctcaaatatttatgcaccttytccttcattgttytctttaaatmtgtccncttaaaaagcttcttaagagctcagttaatgcttttgacttaactaggagaaaaagncatgataatacaggcaagatggcattgttagcaattctggtagtggtttggaatgaatcctaagaggcaggkatcttaaggacaaggaaragaagagagagaggnaggnatctttgatctctttctctggtaatcttaangcataattttactanwacatgttctcaattcattyatattattanagctcttnctgcagttgatatctgrgcagagtaagatttgtatttccatttttacttttttgaaagagaatatatggacagattattartayaatttgggcactgtggttntaagaatatctgagtaaaataacaatatgaaataataaacagaagctctanygtcaggtaacaaatagacagcaagaaaggttttgcaccatcctcttacggcctagngagttgacaagttgcttgtagttttaaaaaaataataaastatacccttctggtntatcatcaagagcttaagaatcttggctttcatatttaaaatgcttttggggagacatatattaaaattttagccaagatgatrgacatgtctcaattatatatgtgtgtgtatgtttttaaagctanaaacattacttttagatncctagaatgaaaanttttttctcatctatgcaattcccatatggtttttttnaaatcatattttattcattttctccctttagcaattttcattttatttctcataatttgaacagagacagttctcntacatgatcagatgctttttttttcttcttnccatcatttatgcatgacatagstaangtngactaatttctccagttgattcaagaaactcattaytttgcctcaaattatatgtaaaatatttgttttacttaggttacagttatcagaaagngtagtttttttcttctattaaaatataacattgtgaaagaaaataaaatttatkctattcntttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaacyttcatacatatctngctagcctaaagtctaaatatttgtgttggcatcagaaaaacaaatkaggcagaattgctatgtgtggttgatcttcagntaaattgactgatcacanttatttttgtatcagtctatgtntnattaggaaaaantgtttagttgttttctcccctgattratggtgatantcaagtrtgatacaaaaagaantgtaccaccaaatatttttgtgaggtctgctgttttccatattcattttatgctactgcctttaagaaagaacnagtgtatccttgaaatagmacaaaaatgttttaaaattcataattgcaaaacaaatctgtgactaacttaatgtcttcagatctaaagggtgtaaaaatattgatacttcaatatttcacttgctgccaggaaraacaaaattctyaatcttttgtaawtgggaggaggacttttgcatacatttttactctttaartaacgacaaygacacttatactgtcataataacaattatgtatttctttgtggttttaattttttttgtaattttacatraaangttattttctatttttacgcasataanatatttgtgcataaaat

SEQ ID NO: 4961 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (780)..(780): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgarcanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntnatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 4962 - DNA, 94 bp, Artificial Sequence
  Description of Artificial Sequence: Synthetic oligonucleotide
  modified_base (9)..(9): a, c, t, g, unknown or other
  modified_base (14)..(14): a, c, t, g, unknown or other
  modified_base (84)..(84): a, c, t, g, unknown or other
  modified_base (92)..(92): a, c, t, g, unknown or other
aaaaacagnaaaanttgtataaataatgttcagttatctatttttatttwatttagaagcaatcatctaggtaaaagaccagtnggaacaancc

SEQ ID NO: 4963 - DNA, 324 bp, Artificial Sequence
  Description of Artificial Sequence: Synthetic polynucleotide
  modified_base (97)..(97): a, c, t, g, unknown or other
  modified_base (174)..(174): a, c, t, g, unknown or other
  modified_base (204)..(204): a, c, t, g, unknown or other
  modified_base (227)..(227): a, c, t, g, unknown or other
  modified_base (270)..(270): a, c, t, g, unknown or other
  modified_base (287)..(287): a, c, t, g, unknown or other
aattatttctttttgttgataagaatatgatattttgttggtaagaataggacatatggccttgcttagaagaaaggtgactaagaattgtagttcngaaggggagctattttccagtaacagctctacactctagaagaagatataagaaaattgatgaatacttagttcccngtaatttactctgtctcctataatctgagnttttaatttctccagtgcagtgnttatctgattatcctttgtagataatttcctttgtaagtaranttctgtactagggagancttcacttttcttctttgtctactaacatacttcagg

SEQ ID NO: 4964 - DNA, 339 bp, Artificial Sequence
  Description of Artificial Sequence: Synthetic polynucleotide
  modified_base (32)..(32): a, c, t, g, unknown or other
  misc_feature (95)..(96): This region may encompass 'aa' or is absent in its entirety
  modified_base (102)..(102): a, c, t, g, unknown or other
  modified_base (110)..(110): a, c, t, g, unknown or other
  modified_base (281)..(281): a, c, t, g, unknown or other
ctatatagatcacatagcaatawggaaaaacngatacgtcaagtgagtatactgtgtttayggcttygttaaaacgtggaaaatacaaaaaaaaaagggaanatgaaaanaatcaaagcagggaaaaggctaayacgttttctttcaatatatatttttaaagttttatcaaacaaaaatatagaraatttgtcacttgaaaaagctactgccagtaaattgtaccaagttttggtacaatagtagcaaatttgatttttaatttgtgttgtttttttttngatakgagagctttaaattaatagttttttgagattctcacaattaattgcaattttc

SEQ ID NO: 4965 - DNA, 505 bp, Artificial Sequence
  Description of Artificial Sequence: Synthetic polynucleotide
  modified_base (12)..(12): a, c, t, g, unknown or other
  modified_base (44)..(44): a, c, t, g, unknown or other
  modified_base (85)..(85): a, c, t, g, unknown or other
  modified_base (121)..(121): a, c, t, g, unknown or other
  modified_base (136)..(136): a, c, t, g, unknown or other
  modified_base (179)..(179): a, c, t, g, unknown or other
  modified_base (197)..(197): a, c, t, g, unknown or other
  modified_base (252)..(252): a, c, t, g, unknown or other
  modified_base (278)..(278): a, c, t, g, unknown or other
  modified_base (307)..(307): a, c, t, g, unknown or other
  modified_base (426)..(426): a, c, t, g, unknown or other
  modified_base (441)..(441): a, c, t, g, unknown or other
  modified_base (483)..(483): a, c, t, g, unknown or other
  modified_base (487)..(487): a, c, t, g, unknown or other
  modified_base (496)..(496): a, c, t, g, unknown or other
ccttaaatggtntatcaactaaatggtttatttgaatcaataangaaaattcctagacagcattttttcttttyacttttattcntcattaaaaagacasggagtaagaaaaggaaaaaangyaacatgttataanatattttcccatattaatccaagaacacaataasaacaacaanaaactcagtgagaactcntattaccaattttaagaatgagtctgaggaattttcaaracttttatttaatagnttgaaataatctgtcaaaatgtatcnataaaacamaacagaatgaacaaaatttngagattaaagttgtatcataaaaaaataccaagaagttaaatattccacagttcatttaattaattatccagtatttattctgtaccaactatagcaatggttttaggctacgtgctcnaataaataagtattntaaggctccccatgctccaaatttgtttttaatcttcaccantctntttttagtnttaggcaac

SEQ ID NO: 4966 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1058)..(1058): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagnctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtrtatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4967 - DNA, 77 bp, Artificial Sequence
  Description of Artificial Sequence: Synthetic oligonucleotide
tattcagcaggcaatggagagtcagaaaagcttaagcaaaaatgagcarttcttttaccagaacataggtgataaga

SEQ ID NO: 4968 - DNA, 1304 bp, Artificial Sequence
  Description of Artificial Sequence: Synthetic polynucleotide
  modified_base (27)..(27): a, c, t, g, unknown or other
  modified_base (110)..(110): a, c, t, g, unknown or other
  modified_base (351)..(351): a, c, t, g, unknown or other
  modified_base (429)..(429): a, c, t, g, unknown or other
  modified_base (441)..(441): a, c, t, g, unknown or other
  modified_base (601)..(601): a, c, t, g, unknown or other
  modified_base (663)..(663): a, c, t, g, unknown or other
  modified_base (676)..(676): a, c, t, g, unknown or other
  modified_base (706)..(706): a, c, t, g, unknown or other
  modified_base (737)..(737): a, c, t, g, unknown or other
  modified_base (799)..(799): a, c, t, g, unknown or other
  modified_base (817)..(817): a, c, t, g, unknown or other
  modified_base (937)..(937): a, c, t, g, unknown or other
  modified_base (964)..(964): a, c, t, g, unknown or other
  modified_base (974)..(974): a, c, t, g, unknown or other
  modified_base (1028)..(1028): a, c, t, g, unknown or other
  modified_base (1088)..(1088): a, c, t, g, unknown or other
  modified_base (1093)..(1093): a, c, t, g, unknown or other
  modified_base (1100)..(1100): a, c, t, g, unknown or other
  modified_base (1193)..(1193): a, c, t, g, unknown or other
  modified_base (1210)..(1210): a, c, t, g, unknown or other
  modified_base (1212)..(1212): a, c, t, g, unknown or other
  modified_base (1262)..(1262): a, c, t, g, unknown or other
tgtcakgcacacccttaaatgcagacngtgtgtcctgggaggattaccaacactcccccggccctgcacatcagctgtggaaggtgagattgggaagtgctggcctcctngccaaggcttcagcctccatttctgcttttcaggtcatgttcgaacactgggggtcccaggagacccacccagaccaggcccctctcagggtgggaagagcgtggagcaagaggaggaggctcggcccagracgttggccacaggctgacccgtgcagggggcaagggcttaagacggccccatcttccactccaagtgtggtctcaatcttgttggccagtttatgaaagtcaagcctantgactcagtcagggtcttggcaggaaggaggccagggcgcagacagagatagggatcgctccaggggtgtgtggcccngggctgtggggnagtcctggagcacctccaccccagcctgcagaacacccaggcggagcaggagcagagctgggctgtgtaggggttaggggacacggccagcccgcaaccccagctcccctccatctgcctccagtttccagccagggccccctctgccaaacctggcccnaggcaggggccagggctctgtctactggggccacagggagggtggggagggggccggagctnccagggcaagggnaggggccacccccaccccgtcacgcgcatngaggaggaggaggagcccacactgccccagngtccaccccacgcctacaccagccccacatgagctcgggggtctctgggggtcagtgtctgnagctacagatgtgagcangcatgcgggtgtgcaggacctttgaccgcagcctcccatgcacccctggaaaggtgccttgcctctctccctcactcgccatgtgcagggcagtgggcgagtcccagccagcatgggcancccgcatttctctgcttctgcagcccngactgaccanggccccccaagtgggctccagccctccaggcacctccccgtgccgtggtgcccnccacagggcctggtctcagggctcctccaggactggccaagtccccaggctcctcccccncccanggggggngaggtgcacagcactgacgggcccctgggccactcatctgaactcttgagtcctcctagagcggtgatcccagccgggcagttagcttgagcnagccgagtacttacagnangtcaccaaacayaaggtcccagcccacattccatgacctcagcactgctnacgacgtcctcctgagtccatgaacttcttgacggttctcat

SEQ ID NO: 4969 - DNA, 886 bp, Artificial Sequence
  Description of Artificial Sequence: Synthetic polynucleotide
  modified_base (77)..(77): a, c, t, g, unknown or other
  modified_base (85)..(85): a, c, t, g, unknown or other
  modified_base (117)..(153): a, c, t, g, unknown or other
  modified_base (237)..(237): a, c, t, g, unknown or other
  modified_base (263)..(263): a, c, t, g, unknown or other
  modified_base (365)..(365): a, c, t, g, unknown or other
  modified_base (391)..(391): a, c, t, g, unknown or other
  modified_base (399)..(422): a, c, t, g, unknown or other
  modified_base (441)..(441): a, c, t, g, unknown or other
  modified_base (461)..(461): a, c, t, g, unknown or other
  modified_base (466)..(466): a, c, t, g, unknown or other
  modified_base (603)..(603): a, c, t, g, unknown or other
  modified_base (627)..(627): a, c, t, g, unknown or other
  modified_base (666)..(666): a, c, t, g, unknown or other
  modified_base (676)..(676): a, c, t, g, unknown or other
  modified_base (684)..(684): a, c, t, g, unknown or other
  modified_base (695)..(695): a, c, t, g, unknown or other
  modified_base (739)..(739): a, c, t, g, unknown or other
  modified_base (752)..(752): a, c, t, g, unknown or other
  modified_base (756)..(756): a, c, t, g, unknown or other
gtgcactgtcacttgagaatttcaaattatatgataagtagctaaggcagtcaaagaaaggctttggagatgaccanaaagtacnttatgtaactaagttattcagtccctaaaccnnnnnnnnnnnnnnnnnnnnnnnnnnnnnnnnnnnnngatacaggaaaaaagagcttgtcaaaaaatctcaaaagaataaagtctattggatttaaaccatttccttataaaacctgattnctgtattacagatatgaactctatangcactcaaatcctttcatcaataaaaggcaataagactcttattgagtaacaataagaggcaataaggctcttattgactgtaacattatttaggatagttntttccaatagaaatatcaagaccaangggttacnnnnnnnnnnnnnnnnnnnnnnnngtcagtactataccatcanctctgcaaggtaactgctcngaaanagagcctgaggaatcttttctgatcacagatcttttggttttcccttgcccagttcgacttctttgccgcaccataaatccaccaatacctatccaaaaaagaaattrggtaaactgataartaatttctccctacntttccacagtacacaggataaaantgctttatcttgaatagtaagtcattttccaaaattaantctgtgctantctaaatnaataacctganttttaggtaaaatagaagttaaaaacraccaaaaaaaaaaaaangrcaaagccactnttancacttatcaaacagaatacaaaaagacctgtgtgcacttcctcttctcaacagtatcagtgtaaatatcaaacactaaattacgctggcttatctatttgacaaatattagtgcctcatacatcacataa

SEQ ID NO: 4970 - DNA, 225 bp, Artificial Sequence
  Description of Artificial Sequence: Synthetic polynucleotide
  modified_base (79)..(79): a, c, t, g, unknown or other
  modified_base (126)..(126): a, c, t, g, unknown or other
  modified_base (138)..(171): a, c, t, g, unknown or other
ttaaaattaaagagtatcgtagcataattttctgcaaattaccatttcttttgtctatttatcaaatgtgttagtgtanctccaactgacccatagargtacrtcacttattttaggcatagaaangccatttatggnnnnnnnnnnnnnnnnnnnnnnnnnnnnnnnnnngttttggttttaaaatttgtctcagtataactatttttgctcatctagaattta

SEQ ID NO: 4971 - DNA, 122 bp, Artificial Sequence
  Description of Artificial Sequence: Synthetic polynucleotide
  modified_base (38)..(38): a, c, t, g, unknown or other
  modified_base (44)..(44): a, c, t, g, unknown or other
  modified_base (106)..(106): a, c, t, g, unknown or other
caggcaaacatcctgtgtctgctttgatggaratctgnaataanagaaggtggcaaccacctgaatttctattggtccatgatagtggccctgatcatygcaaacnttttctctttagggta

SEQ ID NO: 4972 - DNA, 919 bp, Artificial Sequence
  Description of Artificial Sequence: Synthetic polynucleotide
  modified_base (184)..(184): a, c, t, g, unknown or other
  modified_base (195)..(195): a, c, t, g, unknown or other
  modified_base (256)..(256): a, c, t, g, unknown or other
  modified_base (276)..(276): a, c, t, g, unknown or other
  modified_base (316)..(316): a, c, t, g, unknown or other
  modified_base (679)..(679): a, c, t, g, unknown or other
tagaggattgcttctctcttaaaatcttaggtgtcccactccaaagaccggcggccagaaaggttatgaaatctgaaatattaaataattgtcattatattgcttccatttgtgaacaacgtgtgtgtgtgttttataaacgaacataaccttcataacgttatacaccacaatgctaaaaaantgacccctggnagagccaggcgcagcacagacagaaagccctgcctgaaagtgactggagccaagagcctgncactctcggctcattccgtncagtgtatggtagcatcttctgacacgcaaggcctgaggncgcgrtgcctgcactactatccaatcagggckctggggtgggaactgtccaatcaggcgcgcagccagggaggaaggggcggcttccggaatctggcgcggcctttgtctcacttcagccagagmgcggggttagggcttcattgccttgtgtcctctgctccgggagacttcggtgattctgccactcmctccgtcgctctgtgacctgcyggcattgaatgatttatagctaagactccaggacacccctgaagccgagaaatggtgagtgtggggggcagggcgtmccgagactggggaggggrctccttggaaccrgctggacatggcggtgacgggacctagtctgcgagtcgagtcntgcagctcagccctcagtcccctccggtgcagggactccgggcgtcctgtcctgtccctgcacggcggctttggccccagccygtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccc

SEQ ID NO: 4973 - DNA, 123 bp, Artificial Sequence
  Description of Artificial Sequence: Synthetic polynucleotide
  modified_base (100)..(100): a, c, t, g, unknown or other
ttattccagcatcagtgcaatctgctacacctactaccattaaagttataaatagtagtgygaargcagccaaagtacaaagagcgccgaggatttcagnaagatagaagctcacctgggaac

SEQ ID NO: 4974 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (83)..(83): a, c, t, g, unknown or other
  modified_base (119)..(119): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (271)..(271): a, c, t, g, unknown or other
  modified_base (328)..(328): a, c, t, g, unknown or other
  modified_base (344)..(344): a, c, t, g, unknown or other
  modified_base (383)..(383): a, c, t, g, unknown or other
  modified_base (390)..(390): a, c, t, g, unknown or other
  modified_base (405)..(405): a, c, t, g, unknown or other
  modified_base (412)..(412): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
ctccactgtgtgcagtggaatcctgggaaatttaagagctactctctntangcngagactttgnaggcccattcagaganctnaataaaacaacatggttgcaggtaatggcaacaagntntagctnaaatcacccangacatttagatrtgtattccaggctgttagtttaatgtttgctgtatgtacnatgtagtcntttctgttaattatntttcttaactaatttttagaaagagtactctanttgangttcanaactgataggganaaaggtgggaatgggaatgggaaactgtacaaatatttaatgactctaaatatttgngagaactgaggaaatnwcacatggattatggtgctaaaaaggactgttatctaantgagttntttgtcctgatccanttcctgntccttatcttattgtactattccatcttctgccacttaaattcacagaaacaaaatgcaagnaaangntntcttncytgccttcccagactgatttaataaaaatggc

SEQ ID NO: 4975 - DNA, 374 bp, Artificial Sequence
  Description of Artificial Sequence: Synthetic polynucleotide
  modified_base (16)..(16): a, c, t, g, unknown or other
  modified_base (22)..(22): a, c, t, g, unknown or other
  modified_base (47)..(47): a, c, t, g, unknown or other
  modified_base (72)..(72): a, c, t, g, unknown or other
  modified_base (96)..(96): a, c, t, g, unknown or other
  modified_base (98)..(98): a, c, t, g, unknown or other
  modified_base (113)..(113): a, c, t, g, unknown or other
  modified_base (145)..(145): a, c, t, g, unknown or other
  modified_base (148)..(148): a, c, t, g, unknown or other
  modified_base (153)..(153): a, c, t, g, unknown or other
  modified_base (176)..(176): a, c, t, g, unknown or other
  modified_base (193)..(193): a, c, t, g, unknown or other
  modified_base (201)..(201): a, c, t, g, unknown or other
  modified_base (234)..(234): a, c, t, g, unknown or other
  modified_base (276)..(276): a, c, t, g, unknown or other
  modified_base (309)..(309): a, c, t, g, unknown or other
  modified_base (321)..(321): a, c, t, g, unknown or other
  modified_base (326)..(326): a, c, t, g, unknown or other
  modified_base (334)..(334): a, c, t, g, unknown or other
  modified_base (349)..(349): a, c, t, g, unknown or other
  modified_base (354)..(354): a, c, t, g, unknown or other
  modified_base (363)..(363): a, c, t, g, unknown or other
caaagtttatatcaanaaaagnggtaaatatttaaaaactgagtttntcaagtagtgtctccctttcattcnccttgcagataaactttcaaacyntngaatatttctccacnacctgaagaatcaggatcaagctctcaaaatnccnagtgngtstttctgacaggtcgtagggntgayctcttgaacatgnccaagatnttttggttgctcatcctatcatgatgtcctgwncatctttcagaaatggaacccatattgatggattcaatgtangcaaaattccactatctaccagatagctgtgcnttcttcattttncaggnagaaacanggttgtagattagantatgntacagcaantattcacctcc

SEQ ID NO: 4976 - DNA, 3741 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (115)..(115): a, c, t, g, unknown or other
  modified_base (210)..(210): a, c, t, g, unknown or other
  modified_base (300)..(300): a, c, t, g, unknown or other
  modified_base (312)..(312): a, c, t, g, unknown or other
  modified_base (355)..(355): a, c, t, g, unknown or other
  modified_base (378)..(378): a, c, t, g, unknown or other
  modified_base (383)..(383): a, c, t, g, unknown or other
  modified_base (389)..(389): a, c, t, g, unknown or other
  modified_base (391)..(391): a, c, t, g, unknown or other
  modified_base (426)..(426): a, c, t, g, unknown or other
  modified_base (429)..(429): a, c, t, g, unknown or other
  modified_base (556)..(556): a, c, t, g, unknown or other
  modified_base (724)..(724): a, c, t, g, unknown or other
  modified_base (734)..(734): a, c, t, g, unknown or other
  modified_base (741)..(741): a, c, t, g, unknown or other
  modified_base (804)..(804): a, c, t, g, unknown or other
  modified_base (888)..(888): a, c, t, g, unknown or other
  modified_base (909)..(909): a, c, t, g, unknown or other
  modified_base (942)..(942): a, c, t, g, unknown or other
  modified_base (974)..(974): a, c, t, g, unknown or other
  modified_base (1044)..(1044): a, c, t, g, unknown or other
  modified_base (1066)..(1066): a, c, t, g, unknown or other
  modified_base (1089)..(1089): a, c, t, g, unknown or other
  modified_base (1129)..(1129): a, c, t, g, unknown or other
  modified_base (1131)..(1131): a, c, t, g, unknown or other
  modified_base (1138)..(1138): a, c, t, g, unknown or other
  modified_base (1143)..(1143): a, c, t, g, unknown or other
  modified_base (1146)..(1146): a, c, t, g, unknown or other
  modified_base (1168)..(1168): a, c, t, g, unknown or other
  modified_base (1260)..(1260): a, c, t, g, unknown or other
  modified_base (1343)..(1343): a, c, t, g, unknown or other
  modified_base (1379)..(1379): a, c, t, g, unknown or other
  modified_base (1434)..(1434): a, c, t, g, unknown or other
  modified_base (1493)..(1493): a, c, t, g, unknown or other
  modified_base (1566)..(1566): a, c, t, g, unknown or other
  modified_base (1586)..(1586): a, c, t, g, unknown or other
  modified_base (1605)..(1605): a, c, t, g, unknown or other
  modified_base (1628)..(1628): a, c, t, g, unknown or other
  modified_base (1635)..(1635): a, c, t, g, unknown or other
  modified_base (1642)..(1642): a, c, t, g, unknown or other
  modified_base (1679)..(1679): a, c, t, g, unknown or other
  modified_base (1711)..(1711): a, c, t, g, unknown or other
  modified_base (1786)..(1786): a, c, t, g, unknown or other
  modified_base (1917)..(1960): a, c, t, g, unknown or other
  modified_base (2082)..(2082): a, c, t, g, unknown or other
  modified_base (2087)..(2087): a, c, t, g, unknown or other
  modified_base (2398)..(2398): a, c, t, g, unknown or other
  modified_base (2468)..(2468): a, c, t, g, unknown or other
  modified_base (2741)..(2741): a, c, t, g, unknown or other
  modified_base (2743)..(2743): a, c, t, g, unknown or other
  modified_base (2794)..(2794): a, c, t, g, unknown or other
  modified_base (2825)..(2825): a, c, t, g, unknown or other
  modified_base (2841)..(2841): a, c, t, g, unknown or other
  modified_base (2866)..(2866): a, c, t, g, unknown or other
  modified_base (2979)..(2979): a, c, t, g, unknown or other
  modified_base (2992)..(2992): a, c, t, g, unknown or other
  modified_base (2994)..(2994): a, c, t, g, unknown or other
  modified_base (3021)..(3021): a, c, t, g, unknown or other
  modified_base (3047)..(3047): a, c, t, g, unknown or other
  modified_base (3074)..(3074): a, c, t, g, unknown or other
  modified_base (3226)..(3226): a, c, t, g, unknown or other
  modified_base (3252)..(3252): a, c, t, g, unknown or other
  modified_base (3263)..(3263): a, c, t, g, unknown or other
  modified_base (3267)..(3267): a, c, t, g, unknown or other
  modified_base (3269)..(3269): a, c, t, g, unknown or other
  modified_base (3378)..(3378): a, c, t, g, unknown or other
  modified_base (3424)..(3424): a, c, t, g, unknown or other
  modified_base (3467)..(3467): a, c, t, g, unknown or other
  modified_base (3512)..(3512): a, c, t, g, unknown or other
  modified_base (3537)..(3537): a, c, t, g, unknown or other
  modified_base (3551)..(3551): a, c, t, g, unknown or other
  modified_base (3557)..(3557): a, c, t, g, unknown or other
  modified_base (3616)..(3616): a, c, t, g, unknown or other
  modified_base (3741)..(3741): a, c, t, g, unknown or other
gctnaccgttctactngttggctagcttgtacctccagataacatctgataatccaatcactagytatcacaaactagatctttcagatgtttcctattaaaatgttygtttaantttgaagtgaattcctagaaaagctcatataatactattrtagaaaatcattaaaatcaacttaataatttgcccaccatgaaacagaacttaangtaaatctacatttctttggttagtatttactktactggtaaagaccaaagaattggtaatgttcaacaaaatatgaaaatgccagtganttaacaaaaaantagctggaaaccaaagaatcttgcttacatcacaatcacagcnaggaaaatgcagcttattttacngccmntccccnangtgaagaatatgtagaarmaacagtaaataaaaanagnagtataatacrgaaatgcctaataycaaagaaattcatgtaacagaatactgaacttcagtatttctaatatacgkatatacacattcctgctaactgtagaatatttcctgcaagttatggtcccngtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatncttacaagantagcagnaaatgatgaagtagtaacaagaggggcagaaaaatagaaagattatcatcggatttgggawtncaaagrcagctcagcaaaatactaggacatggctcatataagatggaataagcctggaaatacacccccctccccaatatttcngaacataaagtctacagaaanagagtcctaatgtattgaacctggtttctcaantgaaacaaaagtctwcaaggaaggagagatangtaaaatttaacaggaatacatatgaagcagtatctttaaagaatgtaaatatatcaaccaaaagtaaanttgagattcaaatttccattgntaaagtcttttcagagtcagaanacataattattatataactattcaaaacaaaacaaaaaanancttactngaaanagnacaactggtttgagaagaaaancttttcatggtagagcagaaataactgtcaaggaaaatacttagaaaaagkcatatataaagagtggcctagttttactgcacacgtctttngccatgcagaaacagctaaatcccatctgacaactactttccctttcgtgtaccttgtctttagagaataaaatatatctggntttgatatagaggagactaattttcacattaaaaantgattttcttaaaagcytggccttacagtttaaaaattatacgattaaaatcaanatattattcctataaaaagccaaactttaatccatttaaatcatgaaacttaaaacttnacttgaagcaatttcaatcatgaaacttaaaactccaaattactattgtgaattaacacttctccactatttnatcttgcaattttaaaaaancacttcagaaagyagcaantttgtaaaacaataaataattcntacctanagtatcntcattttgccatgcagttttacttaaatctcacttangaaatggaactcattcttaaagggtagaatgnacatgatgtaaagcagacamaggaagatttatctttacttactgaraatcaayagtacaattctaagattttttnccatgaaactactgaaataagtcctacttgaaaaaagaaatcccacaagagttagcaattaataaaaacaycaaaatgagaaattccccagcatggaaaattcctgtcatamatgttgatgtttatccagnnnnnnnnnnnnnnnnnnnnnnnnnnnnnnnnnnnnnnnnnnnngaaggaaataatagatgttagttactgtayacccaaaactatactgtattttaggctctatatttactgcagcacagaactaaaagaatttttaaagytctttctattagaaactattatcnatagnttgcatctttatgrcccarctgagttgaaattccaaataagatcmcttcaaatttaataaatggcattcttcattaacagcatttaaaaaataatggctgaaacayataatcaacattacactgaagttctatctgaagacagaaaaagttgccatccacaccaaagctacacatataccttctgattttatagaattgttccaatatcttttcwgtcaatatcattaaaatcamcctacctgtttggaccgaggtctaccaggagaaaattttctcttagtaatagctggtttacccatgccadtttttnggagtgactgagatgtaagttgttggcatgatgtttccagcagasgaactaagagctgaagggtaattangcagcatgtcatgygaaggcaagtctgaagaaggtgttggkgaggaagacacatctgycttgcttatgtctgctgatratgaaaatgaygactctgtctcagatgataactttatagatttgcctccttggtatgaaacatctttcacacaaccctcaattgtaggagtcatttcagagtccatcaatccagtagaaagttcagaatyttctttctgttccttttctccttgtagcctttctataaccaactgttcctcaggacataatgaantnctttcctcatgtggggacamtaaggtttctagtggaagagtgacagattcnatgacwaattttggaggccttgattcttctntggataccactgtttnaggttcctctaacaactgcagttgntcttgctgcacagtgatctggtgtgtaacgacttcaatgttttctgtcacttccattttatcttcaatttgatcttcgccacaaatatgcttcacttcagaagacattttcantcttcactatcancntcattagaaatctgtttttccaattcngtattcactgtatgttgggatgatantacaaaattcagaacatttgttatggnaatgtacaaacaaattttaaattttctaactatagatatataaaacatttggctacactagaacttaaatcagaaggtattcatcaaagcagacrattattaagtgaatgaaagccaaagtacacaaggatttatggattagaatcagccanacaccagaaaacctaatgaaaacatngttttacaacnaagnanttccaaatggattgaaaattacacaggaaaagttctcatactcattttttagttaagaaaatgaggatcaatcatgttatgtgaggtacctaagttaaaaagtaaagantgatctagaatgtgtaggcattttctaatagtagatacccagatgnacaaagttactatagactcaaaagcacagacagaaaagatttnctaaccaccaatatttattttgcttaaccatacctgccaacctanccaaaatattctttggatataatcnttgttcttcatcantgtctntaaattaaaagactaatctcaggaaatctataaacttagatatcagaaacatagtcacnggtaaattttaaatcaggataccagtatgttaaacctttaactcaatctcatcaaggtaatttttaagtyatagtaaaaagacactgctagcctcatttaccaatcagtgactaaaatttatctn

SEQ ID NO: 4977 - DNA, 940 bp, Artificial Sequence
  Description of Artificial Sequence: Synthetic polynucleotide
  modified_base (2)..(2): a, c, t, g, unknown or other
  modified_base (19)..(19): a, c, t, g, unknown or other
  modified_base (92)..(92): a, c, t, g, unknown or other
  modified_base (95)..(95): a, c, t, g, unknown or other
  modified_base (106)..(106): a, c, t, g, unknown or other
  modified_base (108)..(108): a, c, t, g, unknown or other
  modified_base (115)..(115): a, c, t, g, unknown or other
  modified_base (131)..(131): a, c, t, g, unknown or other
  modified_base (155)..(155): a, c, t, g, unknown or other
  modified_base (176)..(176): a, c, t, g, unknown or other
  modified_base (228)..(228): a, c, t, g, unknown or other
  modified_base (238)..(238): a, c, t, g, unknown or other
  modified_base (248)..(248): a, c, t, g, unknown or other
  modified_base (251)..(251): a, c, t, g, unknown or other
  modified_base (257)..(257): a, c, t, g, unknown or other
  modified_base (260)..(260): a, c, t, g, unknown or other
  modified_base (263)..(263): a, c, t, g, unknown or other
  modified_base (266)..(266): a, c, t, g, unknown or other
  modified_base (277)..(277): a, c, t, g, unknown or other
  modified_base (297)..(297): a, c, t, g, unknown or other
  modified_base (317)..(317): a, c, t, g, unknown or other
  modified_base (331)..(331): a, c, t, g, unknown or other
  modified_base (336)..(336): a, c, t, g, unknown or other
  modified_base (347)..(347): a, c, t, g, unknown or other
  modified_base (350)..(350): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (400)..(400): a, c, t, g, unknown or other
  modified_base (422)..(422): a, c, t, g, unknown or other
  modified_base (446)..(446): a, c, t, g, unknown or other
  modified_base (456)..(456): a, c, t, g, unknown or other
  modified_base (466)..(466): a, c, t, g, unknown or other
  modified_base (487)..(487): a, c, t, g, unknown or other
  modified_base (529)..(529): a, c, t, g, unknown or other
  modified_base (550)..(550): a, c, t, g, unknown or other
  modified_base (562)..(562): a, c, t, g, unknown or other
  modified_base (567)..(567): a, c, t, g, unknown or other
  modified_base (578)..(578): a, c, t, g, unknown or other
  modified_base (580)..(580): a, c, t, g, unknown or other
  modified_base (597)..(597): a, c, t, g, unknown or other
  modified_base (606)..(606): a, c, t, g, unknown or other
  modified_base (618)..(618): a, c, t, g, unknown or other
  modified_base (629)..(629): a, c, t, g, unknown or other
  modified_base (659)..(659): a, c, t, g, unknown or other
  modified_base (702)..(702): a, c, t, g, unknown or other
  modified_base (705)..(705): a, c, t, g, unknown or other
  modified_base (709)..(709): a, c, t, g, unknown or other
  modified_base (739)..(739): a, c, t, g, unknown or other
  modified_base (767)..(767): a, c, t, g, unknown or other
  modified_base (770)..(770): a, c, t, g, unknown or other
  modified_base (779)..(779): a, c, t, g, unknown or other
  modified_base (783)..(783): a, c, t, g, unknown or other
  modified_base (834)..(834): a, c, t, g, unknown or other
  modified_base (839)..(839): a, c, t, g, unknown or other
  modified_base (846)..(846): a, c, t, g, unknown or other
  modified_base (907)..(907): a, c, t, g, unknown or other
tncagttttcatcttgttntattcagtttgctccgagggcaaaatcaacagtagtagagatcacaaacattattttgattggcctcacaagnctnatcagtaaaancngaaaaancagaaaatgttacacnagttgcaaagaaagcactcctggngttcactgacatgatagcaanwggaaagaatataaatgcaacaggtgttaacatttagaacagtacttgtaancctgctcatntctagacaantcngggacnctngcngcnaacccttcatntatcactgctgatttccttngacatgaaataygactttangaaaatcttcctanacctnactctggctgnacntgagtggttcntntncctacggcgctggcatatgctgtcaggatttccantatctgtttcgtttctagggtnattcgggcttccttcagccagtcntgtgccactntctggattcncccttcagctgattgacaaantttgctrctagctccagatcaccatgctcaatgcaataggangcatatgacagtaatttaaangtgtttatatcntcagncagagctctgncngcttcarttgctgaggngggaatagnagcagggactgnaggtaggagangaagtactggtacaagctatttmtggtttnatcaatcattgctacccttcgggccagtttttgaacagcatanaanyggnctctaagggtctcttcactgtacaccccangggtcagggactctggagggatagctgnggntaaagcttnrgtnaattmattatcagaacagttggctttgatggcctcaacygcactacccagnggganagyaggntttctgcagatgaggtcttcatgctgtactttaatgcctccactgaaagccagagttrgtnggcttttctggcttcctcttcagcaactgcatg

SEQ ID NO: 4978 - DNA, 221 bp, Artificial Sequence
  Description of Artificial Sequence: Synthetic polynucleotide
  modified_base (2)..(2): a, c, t, g, unknown or other
  modified_base (39)..(39): a, c, t, g, unknown or other
  modified_base (67)..(67): a, c, t, g, unknown or other
  modified_base (103)..(103): a, c, t, g, unknown or other
  modified_base (121)..(121): a, c, t, g, unknown or other
  modified_base (131)..(131): a, c, t, g, unknown or other
  modified_base (136)..(136): a, c, t, g, unknown or other
  modified_base (155)..(155): a, c, t, g, unknown or other
  modified_base (178)..(178): a, c, t, g, unknown or other
  modified_base (186)..(186): a, c, t, g, unknown or other
  modified_base (206)..(206): a, c, t, g, unknown or other
gntgaggacagaagggactctaggaatttcagaagactntaactggggagttttgggggaaakaatntattctttgctgactaaccattggttaggtggtggncagggcaggycatagggnaagctttgangggangggctcaaaaatcagtcantgtaggctatgttatacagtgtnccctgctnaggcctcaataagaagaatngtggaaagttctcta

SEQ ID NO: 4979 - DNA, 394 bp, Artificial Sequence
  Description of Artificial Sequence: Synthetic polynucleotide
  modified_base (7)..(7): a, c, t, g, unknown or other
  modified_base (14)..(14): a, c, t, g, unknown or other
  modified_base (46)..(46): a, c, t, g, unknown or other
  modified_base (51)..(51): a, c, t, g, unknown or other
  modified_base (56)..(56): a, c, t, g, unknown or other
  modified_base (111)..(111): a, c, t, g, unknown or other
  modified_base (120)..(120): a, c, t, g, unknown or other
  modified_base (130)..(130): a, c, t, g, unknown or other
  modified_base (147)..(147): a, c, t, g, unknown or other
  modified_base (184)..(184): a, c, t, g, unknown or other
  modified_base (204)..(204): a, c, t, g, unknown or other
  modified_base (213)..(213): a, c, t, g, unknown or other
  modified_base (227)..(227): a, c, t, g, unknown or other
  modified_base (245)..(245): a, c, t, g, unknown or other
  modified_base (254)..(254): a, c, t, g, unknown or other
  modified_base (260)..(260): a, c, t, g, unknown or other
  modified_base (273)..(273): a, c, t, g, unknown or other
  modified_base (279)..(279): a, c, t, g, unknown or other
  modified_base (301)..(301): a, c, t, g, unknown or other
  modified_base (307)..(307): a, c, t, g, unknown or other
  modified_base (313)..(313): a, c, t, g, unknown or other
  modified_base (320)..(320): a, c, t, g, unknown or other
  modified_base (364)..(364): a, c, t, g, unknown or other
  modified_base (370)..(370): a, c, t, g, unknown or other
  modified_base (373)..(373): a, c, t, g, unknown or other
  modified_base (387)..(387): a, c, t, g, unknown or other
ggcccanctccccnagatgtcacctctctgccttctgagtatcaantcagntctcnttctccctaagcctcccaaactgtggggacttacgtgtsagtgtcatttcagttnttgtatgantatagatacntgaaaaaggaatatttnaaaaattgtcctgacctccctcctcccgacccctgtnggaacccaccacttaaccancaagggccnactcatygagcatnacagcttggggaagaaangccagccgngagccngagaaacaaaaangagggnctgtccctaaaatgcaggatcnaagggnctsganctggagngaaatcaggcagcacctcacrgaatccaggctcacagaaagtcngtttcnatnagaatttaaaacanccctctt

SEQ ID NO: 4980 - DNA, 1276 bp, Artificial Sequence
  Description of Artificial Sequence: Synthetic polynucleotide
  modified_base (6)..(6): a, c, t, g, unknown or other
  modified_base (19)..(19): a, c, t, g, unknown or other
  modified_base (76)..(76): a, c, t, g, unknown or other
  modified_base (96)..(96): a, c, t, g, unknown or other
  modified_base (111)..(111): a, c, t, g, unknown or other
  modified_base (113)..(113): a, c, t, g, unknown or other
  modified_base (172)..(172): a, c, t, g, unknown or other
  modified_base (208)..(208): a, c, t, g, unknown or other
  modified_base (215)..(215): a, c, t, g, unknown or other
  modified_base (270)..(270): a, c, t, g, unknown or other
  modified_base (303)..(303): a, c, t, g, unknown or other
  modified_base (312)..(312): a, c, t, g, unknown or other
  modified_base (317)..(317): a, c, t, g, unknown or other
  modified_base (322)..(322): a, c, t, g, unknown or other
  modified_base (328)..(328): a, c, t, g, unknown or other
  modified_base (343)..(343): a, c, t, g, unknown or other
  modified_base (355)..(355): a, c, t, g, unknown or other
  modified_base (357)..(357): a, c, t, g, unknown or other
  modified_base (465)..(465): a, c, t, g, unknown or other
  modified_base (490)..(568): a, c, t, g, unknown or other
  modified_base (583)..(583): a, c, t, g, unknown or other
  modified_base (630)..(630): a, c, t, g, unknown or other
  modified_base (651)..(651): a, c, t, g, unknown or other
  modified_base (731)..(731): a, c, t, g, unknown or other
  modified_base (747)..(747): a, c, t, g, unknown or other
  modified_base (755)..(755): a, c, t, g, unknown or other
  modified_base (835)..(835): a, c, t, g, unknown or other
  modified_base (859)..(859): a, c, t, g, unknown or other
  modified_base (901)..(901): a, c, t, g, unknown or other
  modified_base (935)..(935): a, c, t, g, unknown or other
  modified_base (1051)..(1051): a, c, t, g, unknown or other
  modified_base (1068)..(1068): a, c, t, g, unknown or other
ttatanacaacaaagttcnctctgcaacaagacaactgtcattgtcacaaaaatcacwttttagactatgatgatntccaccaattccttactganaaccttgctgtgttntntgattactatggatcattggtaataaattagtcaaagaaaaacayccatgtaatacatnctggtgcaaaaacacttaatatgccttatgtgaaanacaatanatttttaaaagcactacacaaagaaatgaggttggttccaaccctcccagtcagngagaagatgtgtgggaatactgaaacaaccttntggaggtcntgtanaaganttatcnatactactggatagntttggtgtcatnanagaaattaaatatgaatatttagacacacatgtctgtaagccagagacaytaagtttaaagcaataatcaactaagaaatttttctttaaacagttgaaaaagcaaangacaggctataactaaagataattnnnnnnnnnnnnnnnnnnnnnnnnnnnnnnnnnnnnnnnnnnnnnnnnnnnnnnnnnnnnnnnnnnnnnnnnnnnnnnnagcaaactttactantgatcaatgaaagtgatgagtatttgagtatacacaaaagtagacangaaatkccaacagtggcatanatgaagctaaatgaagtaaagggagcaaggttcttatggcaggagaaaagtgagaggaaacaaaatgatcatctttaganaaggtcatttcctaanagacagcngtaaaaagagaagagataaataaaaaagacaaaaacattgagcttaaattagaacagagcttatcacagatccttaaacntgatgaaactattrcttaagaaantccagacaacacataagaataaaagcattggtgaacagcaanaaaagtcaaaatagctgtcatacagtgtgaattnaagaaggaccaaatcagcattgctttctaatttccatcacaccctatcatctgccaattttcatcactggcaggacactgkgctgagtgatttgtctataaaagagaatctctggnaagaaaaaataaatcanggatgtcatccaaagaggctagaccgtatcattggcaggtagataagaaaggtcagaggactgacagaatttagggyaaaagaaaagcarcaggacttaatgtcaagaaatacaaagataaccaaagaaaagaggctggagttaaagcttaagtgaagtaaaaggaattaaagctaaatgatgagtaaatacattgaggaacaggggg

SEQ ID NO: 4981 - DNA, 1149 bp, Artificial Sequence
  Description of Artificial Sequence: Synthetic polynucleotide
  modified_base (70)..(70): a, c, t, g, unknown or other
  modified_base (149)..(149): a, c, t, g, unknown or other
  modified_base (251)..(251): a, c, t, g, unknown or other
  modified_base (254)..(254): a, c, t, g, unknown or other
  modified_base (294)..(294): a, c, t, g, unknown or other
  modified_base (321)..(321): a, c, t, g, unknown or other
  modified_base (353)..(353): a, c, t, g, unknown or other
  modified_base (374)..(374): a, c, t, g, unknown or other
  modified_base (380)..(380): a, c, t, g, unknown or other
  modified_base (400)..(400): a, c, t, g, unknown or other
  modified_base (409)..(409): a, c, t, g, unknown or other
  modified_base (489)..(489): a, c, t, g, unknown or other
  modified_base (522)..(522): a, c, t, g, unknown or other
  modified_base (544)..(544): a, c, t, g, unknown or other
  modified_base (670)..(670): a, c, t, g, unknown or other
  modified_base (732)..(732): a, c, t, g, unknown or other
  modified_base (758)..(758): a, c, t, g, unknown or other
  modified_base (796)..(796): a, c, t, g, unknown or other
  modified_base (801)..(801): a, c, t, g, unknown or other
  modified_base (816)..(816): a, c, t, g, unknown or other
  modified_base (848)..(848): a, c, t, g, unknown or other
  modified_base (881)..(881): a, c, t, g, unknown or other
  modified_base (954)..(954): a, c, t, g, unknown or other
  modified_base (957)..(957): a, c, t, g, unknown or other
  modified_base (1039)..(1039): a, c, t, g, unknown or other
  modified_base (1043)..(1043): a, c, t, g, unknown or other
  modified_base (1108)..(1108): a, c, t, g, unknown or other
ttcaagagcaacacatttctattccctcttccatagtaaytgttaataaacattagttccattttctacnatttctgttctacaatagaggctttaaaatatcttaagaaatrtaacaccattttaataatttggcaagtagaagtaangataccatgaatcctgagatttcactttcaaaaatgtataagctacatttattttacaatataacttttaggaacaaagttgtcttctccttctgacactgnttntcaaaaactgtgctaaaagctttgagtgatgtttgattantccttttattttggggtccttatagcngttarttaccacattctgccagttctttccangtgaatgcctcacatttcaanggatcnttttctattaccaatgtatnatctgaaanattttactaaytggtttttctgaagctcaatgtccatgtctccttccctcccaagctatccctacccattaatactgtanttttcacctgctcaaaagtccatatggttgccngtaacataccaaataagaaccnaattcctaaagcttgacattcaaatccttttttcaactagctacaatccacttttccaactcttttttccactgctctccctcaggagtagccttttttagcaaaatgacttattctgagatacanaaacaacctttccagatcagagacatcaaaagccattcaggcttcaytgagacaaaagatangcattcaactcagaataacagtaagnaatcaacttatagggaaaccagatctagccatgttctntaaanatgagagataacccngttggctcatgccactgtccttatttataacngcccctatttgcctttctacttctctgaactcnttatccttcaaatctacmatcttttcaaaaacccaaacacagagtcacctcagtcaccaytacctgcccttcnccnaccccacccaatgcctgtggctttcaggtcatttattttgcaataaacttgtyatctcaattttactggttctcttttagantcanacagctgagattatgatagattcattagtaagctgaatgggraagraaaggatattyacattccnaggccaattttcaatgctttttggaagattctgttaaattc

SEQ ID NO: 4982 - DNA, 1869 bp, Artificial Sequence
  Description of Artificial Sequence: Synthetic polynucleotide
  modified_base (59)..(59): a, c, t, g, unknown or other
  modified_base (224)..(224): a, c, t, g, unknown or other
  modified_base (240)..(240): a, c, t, g, unknown or other
  modified_base (319)..(319): a, c, t, g, unknown or other
  modified_base (460)..(460): a, c, t, g, unknown or other
  modified_base (466)..(466): a, c, t, g, unknown or other
  modified_base (680)..(680): a, c, t, g, unknown or other
  modified_base (725)..(725): a, c, t, g, unknown or other
  modified_base (793)..(793): a, c, t, g, unknown or other
  modified_base (905)..(905): a, c, t, g, unknown or other
  modified_base (948)..(948): a, c, t, g, unknown or other
  modified_base (1002)..(1002): a, c, t, g, unknown or other
  modified_base (1329)..(1329): a, c, t, g, unknown or other
  modified_base (1333)..(1333): a, c, t, g, unknown or other
  modified_base (1352)..(1352): a, c, t, g, unknown or other
  modified_base (1436)..(1436): a, c, t, g, unknown or other
  modified_base (1545)..(1545): a, c, t, g, unknown or other
  modified_base (1593)..(1593): a, c, t, g, unknown or other
  modified_base (1632)..(1632): a, c, t, g, unknown or other
  modified_base (1758)..(1758): a, c, t, g, unknown or other
  modified_base (1787)..(1787): a, c, t, g, unknown or other
  modified_base (1808)..(1808): a, c, t, g, unknown or other
  modified_base (1822)..(1822): a, c, t, g, unknown or other
gtgtttctaaaattgtcactgccggtcgtttggaagaatctgagaagtagcagctctgntcttgtttccagaactgcatcctmtgctgaataggtctgggtgcccccagcgcaagcctcaccttattcacttactgactcagttatctcctgactagagaagaggcagacccatctccatcctaggaggagctcttagttcctccagacagggatgtctccctnggaccaggcagtgtgnctgggatgagccattcatcatcagggaagacacaggctacctgggtagtcatggtgtagaatgcctccagcacagtgcncagargcccctgaatctgggaagaaagctacttccacatcaggtgagaatgcacctctgcccatacctggactgggtcttgataacgccctcagaaatagcatgcagggagtcaccagtcttttgaagtggtggtggttgntctctnggtaaccaagatctgggctgcttgctgtgcccagtggcaccccttgagggtctcttatggtgggcatcactggtcttcttaatttgctactgtgtccatcctcagagtcctttgctttctttttcaaagtcaagctgtgctcatatcctagactctttcctgtggagaaagcacgtgagttaaagattcaccacaatagttcacacagaagctnattccagaaccttcccatgcacattcaggtgacccccacttgtcnacctcccacttgccagctccctcagcctgcctaataaagtgagattgagttcgctcctgggtccccanatgctctctgaatgccaggatctctaaaattctttcaamcaccaagaagaccccttcttacccaagccttgcttgtcttgcttgtctgttaggataaaaaagcaagactctnacctgctctatcttgtcaggtgtccttgaaattwttttttttncttcatttcttctgctcatctgagctggactctgattctgttgataaawatggngtgtgtgtgagtgcctccaactgaacaccttggaagccttagtccatttttgatacactagagatgaggtttccacaaaaactcagctctcctctgtgctccagcgcccaggatctgtaaagtgctgcattcaaaaacgctctcagtttctttcycaggggagactgtgttaatctatatcctgtcccttctcaccttggragagtcaagtcttayttgatctagcattgctgtttctggttttgagcttagttttcttggaattctatttcccatttggattgsggtctggtcctagtggaaaagggagttcgggtgattcacctntctntagacccagagtcccatantctatttctgactcatatttgtgggtcattttctcaactgatgctgttcagccagcgtcaaaagtgagtgggaagaatacagtnccaggagatcatcaccacatttctcaaagccacctgagggctgtaatccatttcctgtcctcaattacaaaataaactcctatcaaagacatacagcttagtatccttnattccacccctctttgcaaccttcataagaacagcccaaggtcttacntgagctttgagtgcagctstcactggaatggaaagagancatcttgcctttttcttcaaatcatttctcctcctcatctgagcccctttctgcaaaggagatatgttggaaagggggctggccagtgaggtcttggatggaggcacagtgagaattttggtctgnagttccccattccatgttgaakctcaaanaaaggtcctctctcttacacntccagattcagagngtagcatgttatgctggacttgtcttttttaagtctctctttgctty

SEQ ID NO: 4983 - DNA, 642 bp, Artificial Sequence
  Description of Artificial Sequence: Synthetic polynucleotide
  modified_base (7)..(7): a, c, t, g, unknown or other
  misc_feature (38)..(38): May or may not be present
  modified_base (95)..(95): a, c, t, g, unknown or other
  modified_base (108)..(108): a, c, t, g, unknown or other
  modified_base (113)..(113): a, c, t, g, unknown or other
  modified_base (119)..(119): a, c, t, g, unknown or other
  modified_base (127)..(127): a, c, t, g, unknown or other
  modified_base (135)..(135): a, c, t, g, unknown or other
  modified_base (138)..(138): a, c, t, g, unknown or other
  modified_base (219)..(219): a, c, t, g, unknown or other
  modified_base (296)..(296): a, c, t, g, unknown or other
  modified_base (300)..(300): a, c, t, g, unknown or other
  modified_base (314)..(314): a, c, t, g, unknown or other
  modified_base (323)..(323): a, c, t, g, unknown or other
  modified_base (463)..(463): a, c, t, g, unknown or other
  modified_base (520)..(520): a, c, t, g, unknown or other
  modified_base (524)..(524): a, c, t, g, unknown or other
  modified_base (619)..(619): a, c, t, g, unknown or other
tggattngttcttcgtaaatcaaaccctttgtcattttcttgcaaatagcctaccctttctcttacacgtcctttgacacattttagatggtttngccatacaaaacntttcnattttnagttaaangtaggctnagnaaacatttcaagaaactgaagtgtttcttttttcacctgcttttaatctaaagtcttattatatctggattttaacatttnttaaaagtaatgtcagattataaatgtttggattttattcattttctaaatgattctgactggtttcctacatatanaatnatgaccygcaaaanaagatgtgncctttactttctaattatttgcaactaatctgtactggtttatacatctaggaaactgatgagcaactggtgggagtgtgtatctttttcatatgaagcatgcttctagtggtttactattagacaataatgggttggcntttgcaataatattccaaccaattatattaaggatttctgctgctttttcatgaganaccnagatgatacattatttctagttagttcaataatatgagaaaatgaattaagattttttataaaattatcctgtgtttctggataaatcctaaatntgaaattcactgtagaatataaa

SEQ ID NO: 4984 - DNA, 203 bp, Artificial Sequence
  Description of Artificial Sequence: Synthetic polynucleotide
  modified_base (1)..(1): a, c, t, g, unknown or other
  modified_base (4)..(4): a, c, t, g, unknown or other
  modified_base (9)..(9): a, c, t, g, unknown or other
  modified_base (11)..(11): a, c, t, g, unknown or other
  modified_base (13)..(13): a, c, t, g, unknown or other
  modified_base (15)..(15): a, c, t, g, unknown or other
  modified_base (37)..(37): a, c, t, g, unknown or other
  modified_base (97)..(97): a, c, t, g, unknown or other
  modified_base (111)..(111): a, c, t, g, unknown or other
  modified_base (141)..(141): a, c, t, g, unknown or other
  modified_base (190)..(190): a, c, t, g, unknown or other
nttnttttntntnanattgctgcagcaaaaccarctncaccaaaaagccaggtaacmttaacaaaagaattccctgtatcatctggatctcaacatnggaaaaaagaagcngatagtgtttatggagaatgrgttcctgtngagaaaaatggtgaagaaaacaaagatgatgataatgttttcagcagcnatttgccctcaga

SEQ ID NO: 4985 - DNA, 900 bp, Artificial Sequence
  Description of Artificial Sequence: Synthetic polynucleotide
  modified_base (3)..(3): a, c, t, g, unknown or other
  modified_base (21)..(21): a, c, t, g, unknown or other
  modified_base (25)..(25): a, c, t, g, unknown or other
  misc_feature (76)..(76): May or may not be present
  modified_base (84)..(84): a, c, t, g, unknown or other
  modified_base (112)..(112): a, c, t, g, unknown or other
  modified_base (118)..(118): a, c, t, g, unknown or other
  modified_base (276)..(276): a, c, t, g, unknown or other
  modified_base (291)..(291): a, c, t, g, unknown or other
  modified_base (296)..(296): a, c, t, g, unknown or other
  modified_base (305)..(305): a, c, t, g, unknown or other
  modified_base (320)..(320): a, c, t, g, unknown or other
  modified_base (343)..(343): a, c, t, g, unknown or other
  modified_base (360)..(360): a, c, t, g, unknown or other
  modified_base (373)..(373): a, c, t, g, unknown or other
  modified_base (383)..(383): a, c, t, g, unknown or other
  modified_base (414)..(414): a, c, t, g, unknown or other
  modified_base (429)..(429): a, c, t, g, unknown or other
  modified_base (445)..(445): a, c, t, g, unknown or other
  modified_base (472)..(472): a, c, t, g, unknown or other
  modified_base (477)..(477): a, c, t, g, unknown or other
  modified_base (481)..(481): a, c, t, g, unknown or other
  modified_base (487)..(487): a, c, t, g, unknown or other
  modified_base (490)..(490): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
  modified_base (530)..(530): a, c, t, g, unknown or other
  modified_base (584)..(584): a, c, t, g, unknown or other
  modified_base (586)..(586): a, c, t, g, unknown or other
  modified_base (600)..(600): a, c, t, g, unknown or other
  modified_base (615)..(615): a, c, t, g, unknown or other
  modified_base (618)..(618): a, c, t, g, unknown or other
  modified_base (657)..(657): a, c, t, g, unknown or other
  modified_base (661)..(661): a, c, t, g, unknown or other
  modified_base (686)..(686): a, c, t, g, unknown or other
  modified_base (688)..(688): a, c, t, g, unknown or other
  modified_base (728)..(728): a, c, t, g, unknown or other
  modified_base (747)..(747): a, c, t, g, unknown or other
  modified_base (771)..(771): a, c, t, g, unknown or other
  modified_base (795)..(795): a, c, t, g, unknown or other
  modified_base (811)..(811): a, c, t, g, unknown or other
  modified_base (819)..(819): a, c, t, g, unknown or other
  modified_base (865)..(865): a, c, t, g, unknown or other
  modified_base (871)..(871): a, c, t, g, unknown or other
  modified_base (899)..(899): a, c, t, g, unknown or other
atnaggtgagttaaactgganttgngggggaatgttggccaagtggcaggcagggtgggcctgggcctgagggaacgccatggncccctagacttgttcctgctgacagagngccagnggcygggcaggagcatragcarggtgggtttgcatctgtcactggaggagcgctccgaatgcttctcaggacaaaagcaggaggcygccattgttcacaggatgtgagatctaatatggttcaggctggggcaaatcagtgaagatcaaaatccctcntcttccacaatgagngactngaatcaaangtggatgtgctcccncctgctcacaaagggtcctcacntgccccagggccctccnctggggcacagtncacattaggngacacacaaacagcctgagggtgcccagtcnctgagcagccccagncgctgtgccrttaccngcaggcagggccctgcaggagaccttngcctncccngaccanagnggctgcagggntgctgnggggagagggccagnggccgcancacagctgggaatggctccagaggggagggtggagagtgcgctggcccctgggngnactcagagaggagntgcgtgtgtttggcnctngtggacatggtgtgtggcagtgtgagccaacaggccaangggnggcaagcataggaggctttatggancnccctgaagaaccactgtgtggaggggaaatggccscctgngaggaaagtcytagcagcnggtggagcgcaaccagatgcgggnccagactgatggggtctccatggnagcccaggtgggaggnggaggagnaagggagacagtgagaaggttgtcaccaggccctcactaatacccngggagnagcccgtgtgcaaaggaggtgaaggatng

SEQ ID NO: 4986 - DNA, 260 bp, Artificial Sequence
  Description of Artificial Sequence: Synthetic polynucleotide
  modified_base (15)..(15): a, c, t, g, unknown or other
  modified_base (44)..(44): a, c, t, g, unknown or other
  modified_base (96)..(96): a, c, t, g, unknown or other
  modified_base (122)..(122): a, c, t, g, unknown or other
  modified_base (149)..(149): a, c, t, g, unknown or other
  modified_base (188)..(188): a, c, t, g, unknown or other
  modified_base (200)..(200): a, c, t, g, unknown or other
  modified_base (204)..(204): a, c, t, g, unknown or other
  modified_base (207)..(207): a, c, t, g, unknown or other
  modified_base (209)..(209): a, c, t, g, unknown or other
  modified_base (212)..(212): a, c, t, g, unknown or other
  modified_base (214)..(214): a, c, t, g, unknown or other
  modified_base (225)..(225): a, c, t, g, unknown or other
  modified_base (228)..(228): a, c, t, g, unknown or other
  modified_base (246)..(246): a, c, t, g, unknown or other
ctcataattttagtntatcttttagctttatgttgcyataaacntttcattatatacatgatcaacaacagcawattatctcacctcagtatttanttattttacaaactgatttatgattnctaacatgtaactgaaggtatacactnttagaacacagttttcagtagaaagtagcactgccattnagtaataaaatnttynaanantanancaacattcttntanaagtttgcatgttgtttnctgaggtctaaagc

SEQ ID NO: 4987 - DNA, 1291 bp, Artificial Sequence
  Description of Artificial Sequence: Synthetic polynucleotide
  modified_base (173)..(173): a, c, t, g, unknown or other
  modified_base (241)..(241): a, c, t, g, unknown or other
  modified_base (271)..(271): a, c, t, g, unknown or other
  modified_base (282)..(282): a, c, t, g, unknown or other
  modified_base (440)..(440): a, c, t, g, unknown or other
  misc_feature (623)..(624): This region may encompass 'at' or 'cc'
  modified_base (834)..(834): a, c, t, g, unknown or other
  modified_base (863)..(863): a, c, t, g, unknown or other
  modified_base (1050)..(1050): a, c, t, g, unknown or other
  modified_base (1100)..(1100): a, c, t, g, unknown or other
gcatcagtttcagagtggagccctttgagttttccagatcttgtccagtgacctgctgcagctctgtgagaggcttctggtgtcaacagaatcctgtaagttaaacaagcaccttagcagtgggaggtcagagctacaaaataaccagagccataatcacaactgtgcctccntgtaaactgttagtggagtagagtatttttgttcttccccttacctcagacttagctggacagggacngggatattacagctagattcgggatctgtngctccaccagngcagaaccattttctataatatttgcaccccacaaagcctgagtgtctcctgtctcaggatcattatggaggcrtcagcccatagtcactggggacgctctcaccagcacctgtgaattttggagacatttgaggatgtcctstgcaaattggggtcngtctgactacaaggtttaattctgcccccattttagaggaagagaaatggttcagccakggtttgttcctcccctcacagaaataatttccttgatttgtacccagatgggagttgcttcagttttctggttctttggtgaaaaatgaggagatctggagactcaaactggtcaataagctamytgcttctatttcrtatgtcattagaaaaagagatgaagcagtcatggtccctaccatgaaggarcttgcartctagagcacatgaataagtagttgaattcagcatcrtgtgttaagcacaaagacggaaggtgtagaggagacttaagcttcatttgggtcacatcccttgttttgagttttgatgccaccaactgaaggtctattcanggacagaagagaagttattatttgtattntttttaccttgctaagaataaatatttaccttctaatataattgctctaggaaaacgtaagggttttggttaaattccttcttatcgtatgttacaaaakagggaagtggctaaaatagrttaaaattgcacaaacyctgaaaatcagatttctcttggtcaggcttagaaaagataaaactgaaanttcttagcagcatggagatctgtcccaaccctgcgcagatccaccctctnctgctaaactttctccaggtctgatcccacactgaaatctytcacagaactgcctagaggagatcagagtttggagtgactacccctactgcctctccacagctggtgctcacaatttcctgaaacccaaaaggagataaaaggggaaaaactatatactttggggccttaaattcttttttaaaaaatta

SEQ ID NO: 4988 - DNA, 754 bp, Artificial Sequence
  Description of Artificial Sequence: Synthetic polynucleotide
  modified_base (4)..(4): a, c, t, g, unknown or other
  modified_base (16)..(16): a, c, t, g, unknown or other
  modified_base (55)..(55): a, c, t, g, unknown or other
  modified_base (110)..(110): a, c, t, g, unknown or other
  modified_base (142)..(142): a, c, t, g, unknown or other
  modified_base (156)..(156): a, c, t, g, unknown or other
  modified_base (180)..(180): a, c, t, g, unknown or other
  modified_base (191)..(191): a, c, t, g, unknown or other
  modified_base (228)..(228): a, c, t, g, unknown or other
  modified_base (267)..(267): a, c, t, g, unknown or other
  modified_base (273)..(308): a, c, t, g, unknown or other
  modified_base (338)..(338): a, c, t, g, unknown or other
  modified_base (379)..(379): a, c, t, g, unknown or other
  modified_base (420)..(420): a, c, t, g, unknown or other
  modified_base (489)..(489): a, c, t, g, unknown or other
  modified_base (504)..(504): a, c, t, g, unknown or other
  modified_base (511)..(511): a, c, t, g, unknown or other
  modified_base (556)..(556): a, c, t, g, unknown or other
  modified_base (563)..(563): a, c, t, g, unknown or other
  modified_base (583)..(583): a, c, t, g, unknown or other
  modified_base (645)..(645): a, c, t, g, unknown or other
  misc_feature (673)..(674): This region may encompass 'gt' or 'tg'
ggcncaccttgtcctnctcattcaaagtctaccatcagagctttggtcctcttgnccagtcctgctgtacttggtctcctgtgattcctctcccagatcctgaaaccttnggcttctgtgcacctgcagtctctcacctccntggacatggagatnctgtattctcagagacagatgatncctcattgtgnctcctatggcccatgcaaatgatttccccaacacagncatgagttttcctgtatgaaattgaaaggggatgtgggnaactgnnnnnnnnnnnnnnnnnnnnnnnnnnnnnnnnnnnntcacagtggtacaaaaggagtcctcaggcntgctaaggtgttgtgaactagggtgatgttgtcactcaagnctacaatgggggctccatgaagagaaatctagaaaaggatnagcatatgagcaaagaagcaaaacctggggagtagcagggaggggaccaggagcggtgactcaaccggncagggaaaacaccangtacaanagagggtgagaattctgtgctcagcaaagaggagaactcactcancatttcnctcaattttccctcaagaantttcctgtgccaggaaagttcacaatggagaatctccagctccaggtgggaccccaaaagangcagggggactttaggccataggtcttkkgcacaaggtttttccccagttcctacccctttcctttcctctctgtccagcaaacctgcttgtttctgtcacctgccttc

SEQ ID NO: 4989 - DNA, 304 bp, Artificial Sequence
  Description of Artificial Sequence: Synthetic polynucleotide
  modified_base (15)..(15): a, c, t, g, unknown or other
  modified_base (61)..(61): a, c, t, g, unknown or other
  modified_base (104)..(104): a, c, t, g, unknown or other
  modified_base (187)..(187): a, c, t, g, unknown or other
  modified_base (201)..(201): a, c, t, g, unknown or other
  modified_base (212)..(212): a, c, t, g, unknown or other
  modified_base (263)..(294): a, c, t, g, unknown or other
ccttcatagaacagnataaaaagattaagtatccaatagtattcccagaaattatgtaatnctgtcactctcaaaagagaatagcagattacaaagagcaaatnaaagaagcacaccaaaggggagacagaacaagctgagaaagacacccagaattctctaccagttctcaagayaatgaaaaccntaataaagaagatnaagagcaaganacaaaaattatccagtagttactagatattattagagagtgtaaagaaggnnnnnnnnnnnnnnnnnnnnnnnnnnnnnnnnggtgctgggg

SEQ ID NO: 4990 - DNA, 785 bp, Artificial Sequence
  Description of Artificial Sequence: Synthetic polynucleotide
  modified_base (17)..(17): a, c, t, g, unknown or other
  modified_base (20)..(20): a, c, t, g, unknown or other
  modified_base (112)..(112): a, c, t, g, unknown or other
  modified_base (116)..(116): a, c, t, g, unknown or other
  modified_base (133)..(133): a, c, t, g, unknown or other
  modified_base (137)..(137): a, c, t, g, unknown or other
  modified_base (156)..(156): a, c, t, g, unknown or other
  modified_base (173)..(173): a, c, t, g, unknown or other
  modified_base (212)..(212): a, c, t, g, unknown or other
  modified_base (247)..(247): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (319)..(319): a, c, t, g, unknown or other
  modified_base (332)..(332): a, c, t, g, unknown or other
  modified_base (349)..(349): a, c, t, g, unknown or other
  modified_base (383)..(383): a, c, t, g, unknown or other
  modified_base (420)..(420): a, c, t, g, unknown or other
  modified_base (423)..(423): a, c, t, g, unknown or other
  modified_base (434)..(474): a, c, t, g, unknown or other
  modified_base (569)..(569): a, c, t, g, unknown or other
  modified_base (586)..(648): a, c, t, g, unknown or other
  modified_base (650)..(658): a, c, t, g, unknown or other
  modified_base (682)..(682): a, c, t, g, unknown or other
  modified_base (702)..(702): a, c, t, g, unknown or other
  modified_base (705)..(705): a, c, t, g, unknown or other
  modified_base (718)..(718): a, c, t, g, unknown or other
  modified_base (721)..(721): a, c, t, g, unknown or other
  modified_base (770)..(770): a, c, t, g, unknown or other
  modified_base (775)..(775): a, c, t, g, unknown or other
atatttttctttgcctncantgaattccctctcttggcaatgccttataagttaccatgcaaaaaaatataaatgtatctcatttatctgttctcccctaccccccacaacnctanctacctctcacaggacnaagnattggaaaggccttagtgnagccaccacctaaccanagaaatgatccaaactcacatactactacttctttattnttcagtaaagttctccaaactaaaatgaaatatgnagtttgaaaatangtagtaaaaatacagcttttnaaatatatcctctrtgctntttcatagccacttcacantgaccctacttcnccatttataactcaccnagttagttattagtaaacaactcttaatcaaaantaaaaatgaagggctatggaactgttctcatatcccnttnagtgtcttaannnnnnnnnnnnnnnnnnnnnnnnnnnnnnnnnnnnnnnnnagcgcagtgtttaatgaacttgcctaaagycacatcagaaccaccagraagcacaatttcattgtattttgtgtgaatgccctccccagcacaangaacggagctgtacaannnnnnnnnnnnnnnnnnnnnnnnnnnnnnnnnnnnnnnnnnnnnnnnnnnnnnnnnnnnnnnrnnnnnnnnnaaaacctccaaaaaacactgcttncatcactgaaattaaagamnaanaatacaatataantanaataaaatgagaattccttgttatataataagccagtttatcagctttntttgnaaggaagaaa

SEQ ID NO: 4991 - DNA, 421 bp, Artificial Sequence
  Description of Artificial Sequence: Synthetic polynucleotide
  modified_base (9)..(9): a, c, t, g, unknown or other
  modified_base (27)..(27): a, c, t, g, unknown or other
  modified_base (49)..(49): a, c, t, g, unknown or other
  modified_base (67)..(67): a, c, t, g, unknown or other
  modified_base (145)..(145): a, c, t, g, unknown or other
  modified_base (155)..(155): a, c, t, g, unknown or other
  modified_base (183)..(183): a, c, t, g, unknown or other
  modified_base (190)..(190): a, c, t, g, unknown or other
  modified_base (196)..(196): a, c, t, g, unknown or other
  modified_base (214)..(214): a, c, t, g, unknown or other
  modified_base (316)..(316): a, c, t, g, unknown or other
  modified_base (320)..(320): a, c, t, g, unknown or other
  modified_base (324)..(324): a, c, t, g, unknown or other
  modified_base (334)..(334): a, c, t, g, unknown or other
  modified_base (346)..(346): a, c, t, g, unknown or other
  modified_base (372)..(372): a, c, t, g, unknown or other
  modified_base (378)..(378): a, c, t, g, unknown or other
  modified_base (382)..(382): a, c, t, g, unknown or other
gctttacanctttaaatataaatcacnatcatccaggtggcttacccangactaaggaaggtttccnacacaaggtggaggagaargtgctagaattcttatatgagaggacctcatggacartctcttgttggaatgttaggangttgggaganagtagargtagtagggcagtgctatgangtagttnttatcncagaactgcttttagctngttatttaaatgagatggggaatagattaattgtccatatcaaagagtartggtaggattctaatgaaggtgagatgggaaaatctctctccaagccaagtnctgnatcnattaccaggntgtagaacattnaaaaaatgagatagattttataacancctgancctnactttatgaataaagagataaagagaaatgtgttgggca

SEQ ID NO: 4992 - DNA, 225 bp, Artificial Sequence
  Description of Artificial Sequence: Synthetic polynucleotide
  modified_base (98)..(98): a, c, t, g, unknown or other
  modified_base (126)..(126): a, c, t, g, unknown or other
  modified_base (138)..(171): a, c, t, g, unknown or other
ttaaaattaaagagtatcgtagcataattttctgcaaattaccatttcttttgtctatttatcaaatgtgttagtgtayctccaactgacccatagangtacrtcacttattttaggcatagaaangccatttatggnnnnnnnnnnnnnnnnnnnnnnnnnnnnnnnnnngttttggttttaaaatttgtctcagtataactatttttgctcatctagaattta

SEQ ID NO: 4993 - DNA, 469 bp, Artificial Sequence
  Description of Artificial Sequence: Synthetic polynucleotide
  modified_base (9)..(9): a, c, t, g, unknown or other
  modified_base (18)..(18): a, c, t, g, unknown or other
  modified_base (29)..(29): a, c, t, g, unknown or other
  modified_base (31)..(31): a, c, t, g, unknown or other
  modified_base (39)..(39): a, c, t, g, unknown or other
  modified_base (57)..(57): a, c, t, g, unknown or other
  modified_base (92)..(92): a, c, t, g, unknown or other
  modified_base (99)..(99): a, c, t, g, unknown or other
  modified_base (105)..(105): a, c, t, g, unknown or other
  modified_base (137)..(137): a, c, t, g, unknown or other
  modified_base (143)..(143): a, c, t, g, unknown or other
  modified_base (150)..(150): a, c, t, g, unknown or other
  modified_base (170)..(170): a, c, t, g, unknown or other
  modified_base (173)..(173): a, c, t, g, unknown or other
  modified_base (179)..(179): a, c, t, g, unknown or other
  modified_base (214)..(214): a, c, t, g, unknown or other
  modified_base (230)..(230): a, c, t, g, unknown or other
  modified_base (252)..(252): a, c, t, g, unknown or other
  modified_base (277)..(277): a, c, t, g, unknown or other
  modified_base (291)..(291): a, c, t, g, unknown or other
  modified_base (318)..(318): a, c, t, g, unknown or other
  modified_base (323)..(323): a, c, t, g, unknown or other
  modified_base (325)..(325): a, c, t, g, unknown or other
  modified_base (340)..(340): a, c, t, g, unknown or other
  modified_base (343)..(343): a, c, t, g, unknown or other
  modified_base (346)..(346): a, c, t, g, unknown or other
  modified_base (355)..(355): a, c, t, g, unknown or other
  modified_base (361)..(361): a, c, t, g, unknown or other
  modified_base (382)..(382): a, c, t, g, unknown or other
  modified_base (395)..(395): a, c, t, g, unknown or other
  modified_base (402)..(402): a, c, t, g, unknown or other
  modified_base (407)..(407): a, c, t, g, unknown or other
  modified_base (410)..(410): a, c, t, g, unknown or other
  modified_base (412)..(412): a, c, t, g, unknown or other
  modified_base (423)..(423): a, c, t, g, unknown or other
  modified_base (425)..(425): a, c, t, g, unknown or other
  modified_base (453)..(453): a, c, t, g, unknown or other
  modified_base (467)..(467): a, c, t, g, unknown or other
agcctgacnacacatttnccaaaagcagntnaaaaaaangcaagggtctcaggctcngtcacatccaactcattcttatgtgccagggaganacagagnacattntgtgtatctgttrgattgtgaatyaccacttngcatanagactgntctcaacagtgagattcycntcntgtagnaccctcatgcttcagctaggtgcttacaggtgaanagttactcaaaaatcntcatgtagcaaatttggtttcnaccttraattagagagactcaggcntgcaccaaggaaangtctagctatgctcttctccagcctcncaccngnctgcrggtcttagcnttnttngtatcactnggtgtnccgggcttttgtttgaatggncaacctggctgcnatcattngcagnccnantcgctctgccngntctgcaytgtctgcttcaaaagtcaggntcaccagagagagnaa

SEQ ID NO: 4994 - DNA, 3640 bp, Artificial Sequence
  Description of Artificial Sequence: Synthetic polynucleotide
  modified_base (117)..(117): a, c, t, g, unknown or other
  modified_base (184)..(184): a, c, t, g, unknown or other
  modified_base (189)..(189): a, c, t, g, unknown or other
  modified_base (201)..(201): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (271)..(271): a, c, t, g, unknown or other
  modified_base (309)..(309): a, c, t, g, unknown or other
  modified_base (348)..(348): a, c, t, g, unknown or other
  modified_base (476)..(476): a, c, t, g, unknown or other
  modified_base (500)..(500): a, c, t, g, unknown or other
  modified_base (537)..(537): a, c, t, g, unknown or other
  modified_base (604)..(604): a, c, t, g, unknown or other
  modified_base (616)..(616): a, c, t, g, unknown or other
  modified_base (623)..(623): a, c, t, g, unknown or other
  modified_base (628)..(628): a, c, t, g, unknown or other
  modified_base (739)..(739): a, c, t, g, unknown or other
  modified_base (755)..(755): a, c, t, g, unknown or other
  modified_base (758)..(758): a, c, t, g, unknown or other
  modified_base (772)..(772): a, c, t, g, unknown or other
  modified_base (811)..(811): a, c, t, g, unknown or other
  modified_base (898)..(898): a, c, t, g, unknown or other
  modified_base (925)..(925): a, c, t, g, unknown or other
  modified_base (934)..(934): a, c, t, g, unknown or other
  modified_base (1032)..(1032): a, c, t, g, unknown or other
  modified_base (1037)..(1037): a, c, t, g, unknown or other
  modified_base (1066)..(1066): a, c, t, g, unknown or other
  modified_base (1077)..(1077): a, c, t, g, unknown or other
  modified_base (1100)..(1100): a, c, t, g, unknown or other
  modified_base (1139)..(1139): a, c, t, g, unknown or other
  modified_base (1158)..(1158): a, c, t, g, unknown or other
  modified_base (1257)..(1257): a, c, t, g, unknown or other
  modified_base (1297)..(1297): a, c, t, g, unknown or other
  modified_base (1331)..(1331): a, c, t, g, unknown or other
  modified_base (1337)..(1337): a, c, t, g, unknown or other
  modified_base (1381)..(1381): a, c, t, g, unknown or other
  modified_base (1383)..(1383): a, c, t, g, unknown or other
  modified_base (1397)..(1397): a, c, t, g, unknown or other
  modified_base (1509)..(1509): a, c, t, g, unknown or other
  modified_base (1515)..(1515): a, c, t, g, unknown or other
  modified_base (1530)..(1530): a, c, t, g, unknown or other
  modified_base (1576)..(1576): a, c, t, g, unknown or other
  modified_base (1609)..(1609): a, c, t, g, unknown or other
  modified_base (1632)..(1632): a, c, t, g, unknown or other
  modified_base (1659)..(1659): a, c, t, g, unknown or other
  modified_base (1719)..(1719): a, c, t, g, unknown or other
  modified_base (1737)..(1737): a, c, t, g, unknown or other
  modified_base (1747)..(1747): a, c, t, g, unknown or other
  modified_base (1831)..(1831): a, c, t, g, unknown or other
  modified_base (1841)..(1841): a, c, t, g, unknown or other
  modified_base (1854)..(1854): a, c, t, g, unknown or other
  modified_base (1887)..(1887): a, c, t, g, unknown or other
  modified_base (1985)..(1985): a, c, t, g, unknown or other
  modified_base (2066)..(2066): a, c, t, g, unknown or other
  modified_base (2125)..(2125): a, c, t, g, unknown or other
  modified_base (2259)..(2259): a, c, t, g, unknown or other
  modified_base (2273)..(2273): a, c, t, g, unknown or other
  modified_base (2349)..(2349): a, c, t, g, unknown or other
  modified_base (2390)..(2390): a, c, t, g, unknown or other
  modified_base (2504)..(2504): a, c, t, g, unknown or other
  modified_base (2570)..(2570): a, c, t, g, unknown or other
  modified_base (2608)..(2608): a, c, t, g, unknown or other
  modified_base (2639)..(2639): a, c, t, g, unknown or other
  modified_base (2700)..(2700): a, c, t, g, unknown or other
  modified_base (2818)..(2818): a, c, t, g, unknown or other
  modified_base (2898)..(2898): a, c, t, g, unknown or other
  modified_base (2902)..(2902): a, c, t, g, unknown or other
  modified_base (2990)..(2990): a, c, t, g, unknown or other
  modified_base (3004)..(3004): a, c, t, g, unknown or other
  modified_base (3019)..(3019): a, c, t, g, unknown or other
  modified_base (3209)..(3209): a, c, t, g, unknown or other
  modified_base (3223)..(3223): a, c, t, g, unknown or other
  modified_base (3257)..(3257): a, c, t, g, unknown or other
  modified_base (3334)..(3334): a, c, t, g, unknown or other
  modified_base (3371)..(3433): a, c, t, g, unknown or other
  modified_base (3457)..(3457): a, c, t, g, unknown or other
  modified_base (3503)..(3503): a, c, t, g, unknown or other
  modified_base (3521)..(3521): a, c, t, g, unknown or other
  modified_base (3612)..(3612): a, c, t, g, unknown or other
  modified_base (3617)..(3617): a, c, t, g, unknown or other
  modified_base (3639)..(3639): a, c, t, g, unknown or other
tttggttctttcttttcctggtgatcccgtggtgtaacaaacataaattatcttggagcaccagaggtattttcagagggtttctaggaatgatattagagggaaagtgggtaaggntattcctatccatgcctctaaaagtccagcaagttctagtgaattctacaatgaatgttctttaatnagaantggagaccttgnccatgagagatgtcatgtatgaggccctgtagatggattacntacactgtaggctcntggggntgtttanggatgaatccctttttgcagcaaatgcaagcacatgcntgggatccaggcagggacaaaagctcccccttaggaagnaggtgggcacctggaaggcccctcactgaggtggacactggtgtcctgtgctggctgcacgttgtcaagaggcatgagcctgattgggcttgtagagggagagcctcattggggtcacaggttataanaatgtctgccattctccagctgancaagcccatctgcttgcttgccagtgtcaatgccatnttggggtgcactctggaagatgacaagatgcacacaaacctcctcccactaattatccactactaancattcaaaaacnacctgantccanaaatggatatgcgcctgcagggataaacagaacttaagtattttcttatctgggaaagacactgccaaatactacacatttcaggaaaattagtttggaatgtttaaaaantgactgaagggcaatngtnggtgaggtgatggnacagcctcagggctgcacatgaggagggctccctccccnatgcaggcttttcctccaggaactgcaccaggaactgaggaaggattagggagaatcatggaaacatccttctgcggtgcttgctanggagaggaaataaattatgagtaaaanattccctcngaataaagtatgggcatttgttcatacaaatctgtatttctcaaagcttgtggaggtcctgacatagccaccattagctgagaacaaacatttcaccnctccntgcatggggaggtcaagcagsctggaggntgtccctttgnggatgatatttcccagccccttngtcttccctgctcatccctgggcctctgtgtgacgagtnctcatcagtggaatgtagntgatgtagtgtggtcttcagttttctcatcttctttgttctcatgttcctctcatggtgtgaggttaagaaactcatctgcaacatagcacatgacagngtaatctctcttgtggacaaaaaattggcaaaggagaccnccaagttgaccatcccgtatagctgacagtgacnaccacnggtcaacgtcccctccacaatcctgtgtcggaacatcatctgantnactttattagcaanttttctcgagaattatcttaaaaactacttgtctcattttccatgcagttataacctatttttcctagaggacagagagagctgaatactgaatatattgcatgtctcctgntgttgnaagtttgtgactttntcactttctaatttcttatctgcgcagaccactctacagatttttncactgttgtgaccagcattctgaatatcaagtntatttgacgttcttcatatatcnttcagcaccagcttctcatcatttcantcctcactgaccactctaacttacacaatgtgtttctttatttgtttaattctggcatcnctccttaaatttcaccangcccattttntgttatttctacaggtgattgattgttaattttaaattttacttgtgcttactttaatcaggcaataacctaagataaaaaaancattgtaaanaaaagtaaatgcngtaatatttaaggtaagtaagccaacagctgangaaaagggaaatccattatcctgggtaagtgagtatggggaactcatagtatgattatcttcttcagtttaattaatactgctacgcaagttatagtntcctctctctttatatcaaaactttccctaacatgtacaatgaagactcagcacagataccttccaccagactaacctagnacctctcagcgagtgcctgagctgatagtgatagatatcacatttgtctaacaaaaaangacaccctttaaggatatccaccagccatatggggacaatttgaataatttagataaagcccaaacttgataggtagtaatttataatgagaaactgactcctatcttcacatgggatgtttttaggttttgtngtttcttttttttnccatagagaacctgctaacgccactgtccaagttctggatatcttatttcccagtatgagagactgcatattatgntctgacacaaaggaatgtagctgttgttagggataggagangtgatcgtaagaacatgagcagggatccagcagtgctttgtcttttcacagttgcccagacagagacccaggagaacaatgggagaattgacttcagtctctccagtcccatangagtattataccagatgttttatgccactgtttcatagtagaaaaattagtctctaaagaaagtcngttttgaggacaatactattttccagtatccttcaaangccccaaatcagagagcaccacagtgccccntggccaggagctacaagacctgggcctagaaaacaaatgacagaaatatcagtttatcttnccgcatctgtcataaaaatttgaagactgtttccttccatctggataatcataggttgtgatagactggagctgctggtctataaaaataaactggtctgcagtgggtacagaattanacccataatataattgttctcctgaggtccttatgctgttagaccagctgaccaagaaagtgttttaagagctgcagtgnttantggatcctgtcatatttggggctacatttgcagctaccaagagaaacagaaagaagtccatttggcccaggtagagtcaattaatttnttttattttattcnaatgaggtaaaaaantgcatcaaccaaaatgcagatgatgatcaagtgatcaaggacaacagccactcagtgtttcaggtgtgttttagcccaaaagccacacaacatgtgagaacctgaactctggagtcctggccatctctgaggagaatctagatggtggaagggaagacacaatcattaacatctagggaaatttcagggntacctgctgtagtngaaagcaaaccttgagcctctgagacagtgtgangtccatggagactgagacagctactgtctcaagcccctggtcatggaatagtctcaatgtttgtctgtgtgtcactntagaacattgtgtgtaagtgggatgatgcatacaacnnnnnnnnnnnnnnnnnnnnnnnnnnnnnnnnnnnnnnnnnnnnnnnnnnnnnnnnnnnnnnntttatattaaaatgagttacttantttgtgattgttacactatatcttcgaccaagtgtgtgggagaacntgtttgtgtgtttctgtntagtttgtaaaagcgtatgctattttgagtgtgtgtgagtgcgttcttcaatatttgagcctatcaatttgcatgaatgttaattttcctnagtangtgtgagttgcatacttgactng

SEQ ID NO: 4995 - DNA, 327 bp, Artificial Sequence
  Description of Artificial Sequence: Synthetic polynucleotide
  modified_base (35)..(35): a, c, t, g, unknown or other
  modified_base (121)..(121): a, c, t, g, unknown or other
  modified_base (245)..(245): a, c, t, g, unknown or other
  modified_base (254)..(254): a, c, t, g, unknown or other
gaatcatatgttgtccatcccccyctcaggcttgnaagtcctcaaagagacccactatcccatatcactgcccagagggatgatgggagatgcagccttgatcatgtgacttccagcatgntcacctactgccttctgagtagaagaactcactgcagagcagtttacctcattktaccttagttgcatgtgatygcaatgtttgagttattacttgcagagataggagcaaaaattacaaaaanacacagggnagtgggtccttttgtggytttcctagttactcaaattgactttcccccacctttgcacaggtgctttcaatag

SEQ ID NO: 4996 - DNA, 663 bp, Artificial Sequence
  Description of Artificial Sequence: Synthetic polynucleotide
  modified_base (31)..(31): a, c, t, g, unknown or other
  modified_base (97)..(97): a, c, t, g, unknown or other
  modified_base (139)..(190): a, c, t, g, unknown or other
  modified_base (214)..(214): a, c, t, g, unknown or other
  modified_base (227)..(227): a, c, t, g, unknown or other
  modified_base (288)..(288): a, c, t, g, unknown or other
  modified_base (362)..(362): a, c, t, g, unknown or other
  modified_base (369)..(369): a, c, t, g, unknown or other
  modified_base (406)..(406): a, c, t, g, unknown or other
  modified_base (448)..(448): a, c, t, g, unknown or other
  modified_base (510)..(510): a, c, t, g, unknown or other
  modified_base (579)..(579): a, c, t, g, unknown or other
  modified_base (596)..(596): a, c, t, g, unknown or other
tcctatagtatcatggttattgacatgtaantcytttaatggctttctttcctaagctaaraaaaatacaaacatgattccacataatgtatttcanatatttgtatacatttttctacttttctatattttcyacacnnnnnnnnnnnnnnnnnnnnnnnnnnnnnnnnnnnnnnnnnnnnnnnnnnnnaataaaatatacctctaagtcttngtaaccttaaganggtggrgcaaaatatttttattttctgttgttgattatttaaaatttagctayattaaatnttttctgatttagtaaacatacataaggcctatttatagttgaatggcagtcttacaaaacctaagcaaccttngtttacntatctgtgggaaaagcatttttagtagaatgcttgcncatcttcctacattcctgtaatcaaacagtatttatcatcanctatgttggtgactctcactttgacataggctgaaccagaaatcctaggaaaaactgatganagaaagctaaggggaaggayaggaagccgggaaaccctgggaaaggagggattatattacacatgttangggaactagtttgtatntgcggggcacagagcatacacttagataagaagggggtcataaaaccagaaaggcaataaatagaat

SEQ ID NO: 4997 - DNA, 2008 bp, Artificial Sequence
  Description of Artificial Sequence: Synthetic polynucleotide
  modified_base (14)..(14): a, c, t, g, unknown or other
  modified_base (40)..(40): a, c, t, g, unknown or other
  modified_base (54)..(54): a, c, t, g, unknown or other
  modified_base (146)..(146): a, c, t, g, unknown or other
  modified_base (164)..(164): a, c, t, g, unknown or other
  modified_base (202)..(202): a, c, t, g, unknown or other
  modified_base (206)..(206): a, c, t, g, unknown or other
  modified_base (239)..(239): a, c, t, g, unknown or other
  modified_base (280)..(280): a, c, t, g, unknown or other
  modified_base (283)..(283): a, c, t, g, unknown or other
  modified_base (290)..(290): a, c, t, g, unknown or other
  modified_base (307)..(307): a, c, t, g, unknown or other
  modified_base (393)..(393): a, c, t, g, unknown or other
  modified_base (398)..(398): a, c, t, g, unknown or other
  modified_base (400)..(400): a, c, t, g, unknown or other
  modified_base (420)..(420): a, c, t, g, unknown or other
  modified_base (422)..(422): a, c, t, g, unknown or other
  modified_base (444)..(444): a, c, t, g, unknown or other
  modified_base (449)..(449): a, c, t, g, unknown or other
  modified_base (452)..(452): a, c, t, g, unknown or other
  modified_base (466)..(466): a, c, t, g, unknown or other
  modified_base (499)..(499): a, c, t, g, unknown or other
  modified_base (525)..(525): a, c, t, g, unknown or other
  modified_base (532)..(532): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (557)..(557): a, c, t, g, unknown or other
  modified_base (573)..(573): a, c, t, g, unknown or other
  modified_base (583)..(583): a, c, t, g, unknown or other
  modified_base (597)..(597): a, c, t, g, unknown or other
  modified_base (612)..(612): a, c, t, g, unknown or other
  modified_base (670)..(670): a, c, t, g, unknown or other
  modified_base (693)..(693): a, c, t, g, unknown or other
  modified_base (706)..(706): a, c, t, g, unknown or other
  modified_base (709)..(709): a, c, t, g, unknown or other
  modified_base (725)..(725): a, c, t, g, unknown or other
  modified_base (898)..(898): a, c, t, g, unknown or other
  modified_base (915)..(915): a, c, t, g, unknown or other
  modified_base (946)..(946): a, c, t, g, unknown or other
  modified_base (955)..(955): a, c, t, g, unknown or other
  modified_base (959)..(959): a, c, t, g, unknown or other
  modified_base (1080)..(1080): a, c, t, g, unknown or other
  modified_base (1104)..(1104): a, c, t, g, unknown or other
  modified_base (1153)..(1153): a, c, t, g, unknown or other
  modified_base (1215)..(1215): a, c, t, g, unknown or other
  modified_base (1251)..(1251): a, c, t, g, unknown or other
  modified_base (1286)..(1286): a, c, t, g, unknown or other
  modified_base (1381)..(1381): a, c, t, g, unknown or other
  modified_base (1423)..(1423): a, c, t, g, unknown or other
  modified_base (1514)..(1514): a, c, t, g, unknown or other
  modified_base (1521)..(1521): a, c, t, g, unknown or other
  modified_base (1530)..(1530): a, c, t, g, unknown or other
  modified_base (1578)..(1578): a, c, t, g, unknown or other
  modified_base (1586)..(1586): a, c, t, g, unknown or other
  modified_base (1630)..(1630): a, c, t, g, unknown or other
  modified_base (1647)..(1647): a, c, t, g, unknown or other
  modified_base (1650)..(1650): a, c, t, g, unknown or other
  modified_base (1795)..(1795): a, c, t, g, unknown or other
  modified_base (1797)..(1797): a, c, t, g, unknown or other
  modified_base (1844)..(1844): a, c, t, g, unknown or other
  modified_base (1867)..(1867): a, c, t, g, unknown or other
  modified_base (1954)..(1954): a, c, t, g, unknown or other
  modified_base (1965)..(1965): a, c, t, g, unknown or other
caagtgattcatcncccggtgccaaacagcagacgcaggngttaccagtctggntggggcgcccgagctggggacctggggtcctctgggaggggcaagaaggcagcgatgctggcccccgcctccatctgcccatcccatctgcntccacacaccgccctgcngtagctgcttgcagcccttctctgtcagtttctccatncttntggtttggtgataaatgagagttcccatcgggngtgccaccctctgtgtgacggggagcagagaagaccctgcntcnagtcctnctggggraagagcgaanatgctgggaccagccccagctgkcagggggtctccaatcccagcagggaggccccacgcatggctaggatgccccagaccccaggnactgnangaagtggaaaggagggcccncngtcctaactaagggttcagacnccccncancacatccaggcacncccccaccccctaggcctggttctaggtctgcnagctcygagaaggcccctaacaatgngcagtcnaggggctgncngcnrggctcacgcncagtcccrctgccccnggggtagatnyggcccctggcccncgcgctgtggagccntggagtgtctgtgcgccccttccttggagggcagcygctgaggggctgctgcgggacnggggagcctcctggcagcaagcnctcccaatgcgtngcngggacgctgtgatggngacaagatcctggctttgaagaaagccctttccaccctgtccatgtgggggtctcccggtgcccctgagccagcggccccctcctgcaggctccggaggactcccctgcctgcatctggtctcgcatttcctccgtgacctccaagctcccactgggggcacacggctgcccngctgaccccaactctgnccctgtgccggtggtgggcagcatctggcangggggaggnrccntttcttccacactcgcgcgtcctcagcccagatcatccggtgaagtttccccagcaagtggctccccctgccccctccaccctgccaagtgtggtccctgggcycccgmcttcccttctcngcctctgcccctgggtctggggcntgcatccagccatccacgctcagggaggccacctcctccctcgctctcnaccaccacaaagctgcccgggaccttgttctatcctttccaaaagtcctcaggacctgcctntctacggagctcccaaaacgccctgtgagctctccngggcccctcctctccttgctaataatgtcccacanggtgytgcctgcctggccccaaaagaaaaggaccctggagtgagttctgaacacaaactcgatgaaagtggccccctgctccacctgccgagtcngcccctcctcagactctccccttgggcagggaaacctgccgnggcctgactgtttcttcctgaaacagcctcaggctggaaggagagggatccacccttggccattgaagcattcagcaggaatcagccctcngggaccnagaccctgngaccagccccgccccacaggygccggtcctgggcagcctcccttgctnaggccacnctgctcccaagaagccaggatgagcagctcgcaataggcccccnaacacgcagagtgccangcngaggacgggggcaccccagaaaactgcagacactgcatgtcctctgggagccccggccctgggagaygatgtgcagtggctccagctctgacctcatgagcccaagctccgctacacactgggtcctgacctgacctgggtcccngnggctctccggccaggcctctcccggtgcctcccgcccctgaggccgncacccagcatccaggcccctgtntagtcatcccctcttcaggaatctgggtcatggctgcaggataggggctacccagagcaggatgtggagggaggggccgcaaaagcnggagagaatcnacaaggcactatttagccacctgcccttgattctaattctcag

SEQ ID NO: 4998 - DNA, 111 bp, Artificial Sequence
  Description of Artificial Sequence: Synthetic polynucleotide
  modified_base (29)..(29): a, c, t, g, unknown or other
  modified_base (62)..(62): a, c, t, g, unknown or other
  modified_base (69)..(69): a, c, t, g, unknown or other
  modified_base (77)..(77): a, c, t, g, unknown or other
  modified_base (106)..(106): a, c, t, g, unknown or other
taggtagagttgcaaataatttggtgagnggtgcagatggaggtatctcttayctgtgaggnaataagncaagtaanttgctgagaaaaatgtgggtgggagaaantggca

SEQ ID NO: 4999 - DNA, 520 bp, Artificial Sequence
  Description of Artificial Sequence: Synthetic polynucleotide
  modified_base (48)..(48): a, c, t, g, unknown or other
  modified_base (51)..(51): a, c, t, g, unknown or other
  modified_base (54)..(54): a, c, t, g, unknown or other
  modified_base (64)..(64): a, c, t, g, unknown or other
  modified_base (80)..(80): a, c, t, g, unknown or other
  modified_base (119)..(119): a, c, t, g, unknown or other
  modified_base (121)..(121): a, c, t, g, unknown or other
  modified_base (127)..(127): a, c, t, g, unknown or other
  modified_base (138)..(138): a, c, t, g, unknown or other
  modified_base (190)..(190): a, c, t, g, unknown or other
  modified_base (199)..(199): a, c, t, g, unknown or other
  modified_base (214)..(214): a, c, t, g, unknown or other
  modified_base (247)..(247): a, c, t, g, unknown or other
  modified_base (252)..(252): a, c, t, g, unknown or other
  modified_base (258)..(258): a, c, t, g, unknown or other
  modified_base (271)..(271): a, c, t, g, unknown or other
  modified_base (328)..(328): a, c, t, g, unknown or other
  modified_base (344)..(344): a, c, t, g, unknown or other
  modified_base (383)..(383): a, c, t, g, unknown or other
  modified_base (390)..(390): a, c, t, g, unknown or other
  modified_base (405)..(405): a, c, t, g, unknown or other
  modified_base (412)..(412): a, c, t, g, unknown or other
  modified_base (474)..(474): a, c, t, g, unknown or other
  modified_base (478)..(478): a, c, t, g, unknown or other
  modified_base (480)..(480): a, c, t, g, unknown or other
  modified_base (482)..(482): a, c, t, g, unknown or other
  modified_base (487)..(487): a, c, t, g, unknown or other
  modified_base (489)..(489): a, c, t, g, unknown or other
ctccactgtgtgcagtggaatcctgggaaatttaagagctactctctntangcngagactttgnaggcccattcagaganctwaataaaacaacatggttgcaggtaatggcaacaagntntagctnaaatcacccangacatttagatrtgtattccaggctgttagtttaatgtttgctgtatgtacnatgtagtcntttctgttaattatntttcttaactaatttttagaaagagtactctanttgangttcanaactgataggganaaaggtgggaatgggaatgggaaactgtacaaatatttaatgactctaaatatttgngagaactgaggaaatnwcacatggattatggtgctaaaaaggactgttatctaantgagttntttgtcctgatccanttcctgntccttatcttattgtactattccatcttctgccacttaaattcacagaaacaaaatgcaagnaaangntntcttncntgccttcccagactgatttaataaaaatggc

SEQ ID NO: 5000 - DNA, 281 bp, Artificial Sequence
  Description of Artificial Sequence: Synthetic polynucleotide
  modified_base (6)..(6): a, c, t, g, unknown or other
  modified_base (24)..(24): a, c, t, g, unknown or other
  modified_base (90)..(90): a, c, t, g, unknown or other
  modified_base (94)..(94): a, c, t, g, unknown or other
  modified_base (192)..(192): a, c, t, g, unknown or other
tgaccntaactactattcaagaanaaaaaaaaactactcattagaacttaaaaacataaaattgtatgttctacaaaaacaaatcaaccntatntacaaccaagtcctactgaactactgaatgttagaackgaaggcctcaccgtggactcaagagctgacatgaggaacgtcaccaccatcctgctctcntaggagtcctcatcttcaatggacagggtagacactaaaacttgggccatgatccctgcacaagagaagtagtaagaaagtgagtggtg

SEQ ID NO: 5001 - DNA, 100 bp, Artificial Sequence
  Description of Artificial Sequence: Synthetic polynucleotide
  modified_base (8)..(8): a, c, t, g, unknown or other
  modified_base (13)..(13): a, c, t, g, unknown or other
  modified_base (18)..(18): a, c, t, g, unknown or other
  modified_base (43)..(43): a, c, t, g, unknown or other
  modified_base (74)..(74): a, c, t, g, unknown or other
  modified_base (79)..(79): a, c, t, g, unknown or other
ttctgcangccancaccnagtcccacaggcgcctacctgcccnataagaggytccctgccatttctctagtctnccccnttcaacagcacaccaaataag

SEQ ID NO: 5002 - DNA, 2631 bp, Artificial Sequence
  Description of Artificial Sequence: Synthetic polynucleotide
  modified_base (248)..(291): a, c, t, g, unknown or other
  modified_base (295)..(295): a, c, t, g, unknown or other
  modified_base (385)..(385): a, c, t, g, unknown or other
  modified_base (422)..(422): a, c, t, g, unknown or other
  modified_base (471)..(471): a, c, t, g, unknown or other
  modified_base (505)..(505): a, c, t, g, unknown or other
  modified_base (572)..(572): a, c, t, g, unknown or other
  modified_base (599)..(599): a, c, t, g, unknown or other
  modified_base (632)..(632): a, c, t, g, unknown or other
  modified_base (650)..(650): a, c, t, g, unknown or other
  modified_base (711)..(711): a, c, t, g, unknown or other
  modified_base (713)..(713): a, c, t, g, unknown or other
  modified_base (747)..(747): a, c, t, g, unknown or other
  modified_base (774)..(774): a, c, t, g, unknown or other
  modified_base (779)..(779): a, c, t, g, unknown or other
  modified_base (862)..(862): a, c, t, g, unknown or other
  modified_base (911)..(911): a, c, t, g, unknown or other
  modified_base (951)..(951): a, c, t, g, unknown or other
  modified_base (1021)..(1021): a, c, t, g, unknown or other
  modified_base (1097)..(1097): a, c, t, g, unknown or other
  modified_base (1111)..(1111): a, c, t, g, unknown or other
  modified_base (1197)..(1197): a, c, t, g, unknown or other
  modified_base (1227)..(1227): a, c, t, g, unknown or other
  modified_base (1230)..(1230): a, c, t, g, unknown or other
  modified_base (1366)..(1366): a, c, t, g, unknown or other
  modified_base (1370)..(1370): a, c, t, g, unknown or other
  modified_base (1423)..(1423): a, c, t, g, unknown or other
  modified_base (1447)..(1447): a, c, t, g, unknown or other
  modified_base (1656)..(1656): a, c, t, g, unknown or other
  modified_base (1682)..(1682): a, c, t, g, unknown or other
  modified_base (1745)..(1745): a, c, t, g, unknown or other
  modified_base (1766)..(1766): a, c, t, g, unknown or other
  modified_base (1910)..(1910): a, c, t, g, unknown or other
  modified_base (1949)..(1949): a, c, t, g, unknown or other
  modified_base (1969)..(1969): a, c, t, g, unknown or other
  modified_base (1991)..(1991): a, c, t, g, unknown or other
  modified_base (2012)..(2012): a, c, t, g, unknown or other
  modified_base (2021)..(2021): a, c, t, g, unknown or other
  modified_base (2046)..(2046): a, c, t, g, unknown or other
  modified_base (2058)..(2058): a, c, t, g, unknown or other
  modified_base (2090)..(2090): a, c, t, g, unknown or other
  modified_base (2108)..(2108): a, c, t, g, unknown or other
  modified_base (2119)..(2119): a, c, t, g, unknown or other
  modified_base (2150)..(2150): a, c, t, g, unknown or other
  modified_base (2321)..(2321): a, c, t, g, unknown or other
  modified_base (2342)..(2342): a, c, t, g, unknown or other
  modified_base (2425)..(2425): a, c, t, g, unknown or other
  modified_base (2437)..(2437): a, c, t, g, unknown or other
  modified_base (2441)..(2441): a, c, t, g, unknown or other
  modified_base (2450)..(2450): a, c, t, g, unknown or other
  modified_base (2497)..(2497): a, c, t, g, unknown or other
  modified_base (2503)..(2503): a, c, t, g, unknown or other
  modified_base (2540)..(2540): a, c, t, g, unknown or other
  modified_base (2564)..(2564): a, c, t, g, unknown or other
  modified_base (2566)..(2566): a, c, t, g, unknown or other
aagtcactccaccttgatgagagcactgagracacagcagataaactcgaaagtcaaagaatatgggacgtatctcggatgtragcacagtgagcacgcggcctgagtttkggtagaatcgtgagccctgaacagtcagagtttactgcccacttttgctggaggagaagctcctgaacaactagagagactgtggttcccaaagagcagcckgtaggcctgaggactgctctatgaccggcgtcagnnnnnnnnnnnnnnnnnnnnnnnnnnnnnnnnnnnnnnnnnnnnaggncttctctgactaccagatccagcagatgacggccaactttgtggatcagtttggsttcaatgatgaggagtttgcagaccatgacaacantcaagtgagtccacttggatgccccctgcacgaggcncgactccccctcctcgctgctgaagtcccatgggggcagctcccttagnccttgccrggagataacaggtgtttccagttgcntgagggtgctgaggcccccagtgagmaccaggggaggagcactgaggcctcagatgagcaccggggnaggagwcctgaggccccagatgagcancaggggaggagcaytgaggccccagatgagcancgggggaggagcgttgangccccagatgagcaccagaggaggagagctgaggccccagatgagccccgggggaggagcnrngccgaggccccagatgagcagtgggggaggagcnccgaggcccccagatgagcagtgggcngggcngggagcgccgaggccatcccccttgctcttgcagcgccccatttgacaggatcgcggagatcaacttcaacatcgacactgangaggacagtgtgagcgagcggggctgtgcggggtcatgcaggcaccctnttcccaggcagctcaggccgygcccatggctcgstctgtngtgggcctgtgcggtggggctgggagaggcccctctgtggagctaggracagtcgcttttcttgaccctncccatcatgccctccagcccatggcgcccacatcctgaactaagcccctctgggagccctgtggggaragcgcctntctcccccagacyntctggaaactgaccttggcgttttactctgcagcccagcgcrgctctgaggcctgctgcagcgacygcatccagcactttgatganacgaggacatctcggaggacagcracactngcngtgctgcccaggtgaaggccagagccaggtgcggggcctgcccatccccccaaagcctctgccraggaggtgcagcccccagaacacccgtcagatgcccagacgccctgctgtttgttatgccggctcgcagarnaagnamaccsgtcctgcaagcactggcgcccaacgcagcgggtgacmctcaggagcncggagctgaggcctggagygactngtgctcctcactcagggcattctgtgctcaccctcagcctggagcctgstgctgtcactgaccctcagtgttaggcatctgtcctggrccaccaggcatctgactctgcatctccccgaggtttggagccccccatgcttcagaragctgctcaaagaatggcccggagtgcggaggccaggatgggaaggygagcttggaagcagacntgatscgcctggggcaggtgcccccnagaccctggaaagaacaaagcccctcctctggagggtgactcaraaggtggtgctgtggggcncggggaygtgtgtgttggggncaggacatggtaccctggcctaggggtgtggaggcttcatttggagctgaggcatttggggctcacwgtggcccgaaacctgcatctccagctctttcccagccatcctgagtaggggtctgtgctgccctgtgcccggcacanggtggtctcctgcccctgcctctcrgttgttgtcactcngccactgtcaccaagrttgntgggtggtgtccacctagtccncatcgtccacccggcccccanacaatgcgncacaggcctgatgcccaccccagcncagcagcacagnctggcctccaccctcacggctgacatctaggncaggagccagtccacccngcaggctgcgnggctgataagacccctctccttacccctgcnctgggggcagcactgacccactcaggaytttggggagggggcagggatctctgttaggaggtgcygagctcttagctgaggccaaaagagagagcaagggcaacaccctggggaagcaggaacgtcccagataggaggaaggcggctcatccttgaggccagggagggccngtggtgcttggtgagctgccntctctgttggatgcggtcctggataggacagggcagtggcatcacctccacactgtcagcgtcagccatgctggaggcctagnggccctcaggcncctnactgagccncaggtcatggagggcagtggcattgcctccacactatcagcgtcagncctgcnrgaggcctaggggccctcaggtgcctgactgagcccnggatcatggagggtagtggcatcnknacctccacactgtcagtgtcagccctgctggaggcctgggggccctcaggcgcctggctgagccc

SEQ ID NO: 5003 - DNA, 439 bp, Artificial Sequence
  Description of Artificial Sequence: Synthetic polynucleotide
  modified_base (3)..(3): a, c, t, g, unknown or other
  modified_base (57)..(57): a, c, t, g, unknown or other
  modified_base (80)..(80): a, c, t, g, unknown or other
  modified_base (91)..(91): a, c, t, g, unknown or other
  modified_base (217)..(217): a, c, t, g, unknown or other
tantctactgcaaataatacgtttcataaaatgcttaataaaaactttcaataccancatgaaagcaattagaacatganggtgtctgaantagatcatagtagtgtgattacattcaatatctttctataagacgtgatgatacatacagggtaaatmatacaagaagacctaagattattatctcagaatttcctaattagaatgggaatacaantgtgcaatgagagaaatggactgaagacagaaataaaaacaaatgttatgatttaatatgacaaatttaaaatttccactttattttccaccatttttaaagagcattccttayagtattmaktttaatgcatttttaaaaatcagtaagacaagtagcacatttctctagttcarractccrctttcagggttacagttaaagatgatcctagaagtgcat

SEQ ID NO: 5004 - DNA, 1248 bp, Artificial Sequence
  Description of Artificial Sequence: Synthetic polynucleotide
  modified_base (3)..(3): a, c, t, g, unknown or other
  modified_base (36)..(36): a, c, t, g, unknown or other
  modified_base (43)..(43): a, c, t, g, unknown or other
  modified_base (167)..(167): a, c, t, g, unknown or other
  modified_base (169)..(169): a, c, t, g, unknown or other
  modified_base (172)..(172): a, c, t, g, unknown or other
  modified_base (179)..(179): a, c, t, g, unknown or other
  modified_base (204)..(204): a, c, t, g, unknown or other
  modified_base (221)..(221): a, c, t, g, unknown or other
  modified_base (236)..(236): a, c, t, g, unknown or other
  modified_base (252)..(252): a, c, t, g, unknown or other
  modified_base (291)..(291): a, c, t, g, unknown or other
  modified_base (293)..(293): a, c, t, g, unknown or other
  modified_base (298)..(298): a, c, t, g, unknown or other
  modified_base (328)..(328): a, c, t, g, unknown or other
  modified_base (347)..(347): a, c, t, g, unknown or other
  modified_base (369)..(369): a, c, t, g, unknown or other
  modified_base (376)..(376): a, c, t, g, unknown or other
  modified_base (384)..(384): a, c, t, g, unknown or other
  modified_base (402)..(402): a, c, t, g, unknown or other
  modified_base (435)..(435): a, c, t, g, unknown or other
  modified_base (439)..(439): a, c, t, g, unknown or other
  modified_base (471)..(471): a, c, t, g, unknown or other
  modified_base (486)..(486): a, c, t, g, unknown or other
  modified_base (542)..(542): a, c, t, g, unknown or other
  modified_base (556)..(556): a, c, t, g, unknown or other
  modified_base (571)..(571): a, c, t, g, unknown or other
  modified_base (591)..(591): a, c, t, g, unknown or other
  modified_base (649)..(649): a, c, t, g, unknown or other
  modified_base (682)..(682): a, c, t, g, unknown or other
  modified_base (782)..(782): a, c, t, g, unknown or other
  modified_base (793)..(793): a, c, t, g, unknown or other
  modified_base (803)..(803): a, c, t, g, unknown or other
  modified_base (857)..(857): a, c, t, g, unknown or other
  modified_base (911)..(911): a, c, t, g, unknown or other
  modified_base (977)..(977): a, c, t, g, unknown or other
  modified_base (979)..(979): a, c, t, g, unknown or other
  modified_base (1037)..(1037): a, c, t, g, unknown or other
  modified_base (1047)..(1047): a, c, t, g, unknown or other
  modified_base (1053)..(1053): a, c, t, g, unknown or other
  modified_base (1056)..(1056): a, c, t, g, unknown or other
  modified_base (1065)..(1065): a, c, t, g, unknown or other
  modified_base (1080)..(1080): a, c, t, g, unknown or other
  modified_base (1108)..(1108): a, c, t, g, unknown or other
  modified_base (1124)..(1124): a, c, t, g, unknown or other
  modified_base (1166)..(1166): a, c, t, g, unknown or other
  modified_base (1168)..(1168): a, c, t, g, unknown or other
  modified_base (1173)..(1173): a, c, t, g, unknown or other
  misc_feature (1207)..(1208): This region may encompass 'gt' or 'ag'
tanccggacaagtgcatcatctatgatatggtcacntctaacntgagtctcaaatatggattcaactgcygtccttgaactaagctgtagagaacagtgattcttcgttcactgtacatgcgaattctattgtcataatataatcccaaattctttgtgacagcayncntanaaagggnatgtcataaaagagaatttgttctngtttctactttgaaaanagtataatctttatncatttctagaacctcnttcagtggttcattaataaactcttcaaaagggataagngnttttngacaatccagggttttaacaccaagttyantttccagggggtccactcnaggacctttcttgtttcttctntcttmtnccaaaagntcctgaagtgtcagctcnctggactcagggatgggctcttcatcatcttcntcantgtgatttgtgtccacttcccytcccactacnatttgcatagtaaancattttcaagcacttcgaagcagcaacaatggcatcatcatcattcacyagatttngactgttaaattcnttgcttatgactttntaagtaataagttgctgaantgtctccatcattctcygaatctggtctgcattgtatttagaccacagtctgatcagntttccttgggctgcaaggggtagcttgctcatngctttgcaaaataatggcaaagccatttccagatattcaggactgtggagatttcthttctccattmcvataatgaacaaattcagataattaggatctngagagtatacnttgtgatacntcaagtcacattccacgttaggtgacaaatatacaagtgcattgagaaaggcantttcaattttttcattagagagcaatctggtgtagacccttctaatggmatcantatccacagacacatcatcagggcctaatttttgcaaattgttgtctccctgtgagctatcacctntncttgaggaagatgcttctgagtcttcttccatagcagcagcagaacatgcagcttttnccttttcatnttcatnttntcttcatcntttgcttgaagaganttcagttcttccttggtgtgtygtttanctttccrgaagctctntaccaawgcctcagcactagaaaaaactcttccaataacacngnttaanggggaataatcctctctttctctacrtaattcarkaatttcatataccttctcttctgttahgtaagtcacatct

SEQ ID NO: 5005 - DNA, 108 bp, Artificial Sequence
  Description of Artificial Sequence: Synthetic polynucleotide
  misc_feature (66)..(67): This region may encompass 'tg' or 'ca'
  modified_base (102)..(102): a, c, t, g, unknown or other
gttgctgaagctggagyatctcccttttgtttttggagttgtgaggcagrctgtttamattctttyrttacttctgatacactagagatttttagtggaccngactga

SEQ ID NO: 5006 - DNA, 1076 bp, Artificial Sequence
  Description of Artificial Sequence: Synthetic polynucleotide
  modified_base (18)..(18): a, c, t, g, unknown or other
  modified_base (20)..(20): a, c, t, g, unknown or other
  modified_base (27)..(27): a, c, t, g, unknown or other
  modified_base (44)..(44): a, c, t, g, unknown or other
  modified_base (120)..(120): a, c, t, g, unknown or other
  modified_base (212)..(212): a, c, t, g, unknown or other
  modified_base (215)..(215): a, c, t, g, unknown or other
  modified_base (263)..(263): a, c, t, g, unknown or other
  modified_base (314)..(314): a, c, t, g, unknown or other
  modified_base (328)..(328): a, c, t, g, unknown or other
  modified_base (348)..(348): a, c, t, g, unknown or other
  modified_base (374)..(374): a, c, t, g, unknown or other
  modified_base (408)..(408): a, c, t, g, unknown or other
  modified_base (426)..(426): a, c, t, g, unknown or other
  modified_base (449)..(449): a, c, t, g, unknown or other
  modified_base (629)..(629): a, c, t, g, unknown or other
  modified_base (649)..(649): a, c, t, g, unknown or other
  modified_base (677)..(677): a, c, t, g, unknown or other
  modified_base (738)..(738): a, c, t, g, unknown or other
  modified_base (742)..(742): a, c, t, g, unknown or other
  modified_base (775)..(775): a, c, t, g, unknown or other
  modified_base (778)..(778): a, c, t, g, unknown or other
  modified_base (812)..(812): a, c, t, g, unknown or other
  modified_base (843)..(843): a, c, t, g, unknown or other
  modified_base (859)..(859): a, c, t, g, unknown or other
  modified_base (933)..(933): a, c, t, g, unknown or other
  modified_base (953)..(953): a, c, t, g, unknown or other
  modified_base (964)..(964): a, c, t, g, unknown or other
  modified_base (1003)..(1003): a, c, t, g, unknown or other
cagctgcagaaccacaananggaccynagtcccatgtcttattngttcagtggtttttctaartcactgtaaaatttttctacattcctggcctgagaacagaagtaccttttgcttatntattcaattaaattcagtagttggtaaatgtgaataaaggaaatcaaaacmctaytgaagattatttagatatggctgagaagtggggtgancanacctgacccactttaacttagagattcaaaatataaacttaactcagntgcagtcaacaacctgacattaaatgcaarcatacaagtaaagaacccaantaaacagaaaaaanctaacctgctacctaccttnaaacactaaatatagagctcctgtcntcctgtttcttactgatttataacttcaaataanggtcaagaaaaaagctanatatatgaaaagatgagatctgngtttcaatccaaatctttctttcaataaccctactacttgaaaccatagaaggagacaggaacttcctcccttgtttcttttttctttttcaaaactacccactaatcttttaattaaaagtgaatgatggagagatggcaagtgagcaggagaagctgaggaacacagctcccttatgnatttgcacaacgctaatcantcttcacatcttacagagagatctgtantagttacatggaatctaatctgttctactaaagctgatgctgtcagctgccatgcttagcnctcnttcattatgcttgtagacacattttgagaaaanacntwatctagaagagaaacttctaagaaggttttanatactatatgatgctaatattttagataatnttttatgctagtttantctttgtgtattgaaagaactctgattttcctggaagtccctagacagtacatttaattaatcttacctstcanttcaacaagttgccttttantttagtcatanaatcaatctcttggtaataatatatagtgatatccaggnatgtatgatgcaagcaagtttttagtttaaagctaaggaattaaaatgaaaacaatacatagtgctctctgta

SEQ ID NO: 5007 - DNA, 1106 bp, Artificial Sequence
  Description of Artificial Sequence: Synthetic polynucleotide
  modified_base (152)..(152): a, c, t, g, unknown or other
  modified_base (154)..(154): a, c, t, g, unknown or other
  modified_base (174)..(174): a, c, t, g, unknown or other
  modified_base (212)..(212): a, c, t, g, unknown or other
  modified_base (322)..(322): a, c, t, g, unknown or other
  modified_base (386)..(386): a, c, t, g, unknown or other
  modified_base (408)..(408): a, c, t, g, unknown or other
  modified_base (517)..(517): a, c, t, g, unknown or other
  modified_base (539)..(539): a, c, t, g, unknown or other
  modified_base (570)..(570): a, c, t, g, unknown or other
  modified_base (585)..(585): a, c, t, g, unknown or other
  modified_base (695)..(695): a, c, t, g, unknown or other
  modified_base (888)..(888): a, c, t, g, unknown or other
tttaatcaaagacactggttttcgcctgcattttccaaatgtgtggcaagcagggtctcacatccactactctgttctgccagcctaacctggcttgaagtaaaatcttaaatttccggtttcttgctgacattccccaaagscaacttctncnctcccatacattatcaactntttttgtcctttattgcacatttcagaaacagtatttnaattaatcactttttcacagagcagtggatggcaatttgtaaaatacttrttttctacttacaaatatttcacatgagaaaaaagcagaaaataatcccctggcactcanctgtaaaaaatctttctgctgtttctccttgtatcctcccttagcacaaacgcccttattaggncatcttgggattgaggttttcnttgggaaactttatggggcaatgtttccttagccacattcgggcctttttctagtcctgagttttagaactgtcttgagatggcccaagatacaaaccagagccatgtnttttgggagttctggtgaatancagccctttggtaatcttccagaggacacantgagggatgggagtncagcttctcaaaggagcagctgaatgccctgggggtgagagaaatatccaggcttacccttcctgtaaaaaaagaatcccttgggatttttaagattttttttttttttncccccaaccccagtttkcattccatggaaacacattgcttgtcagccaatcagatgctggtattcagagaaaaagatagactattcctgtcttctgaattgtcttatatttgcgaagggagagaaactaacctgaaggacaagaaaaacccaccccagggaggcagtgcaagaacctgcaaagcaaaaagcrnagtggggcacagtgcagtgtctcctgggagggtgggcattgagcacttcagtgaggagtatgggggtgakagaaagtcccaagggataaggtggcctgatttgacacttgagtcakatgtccctgttccagaaagcactgccactccctgagtttgtccccctgtatagatttgctcacttatttcaacttcggtttttttaattaactgtaaattgg

SEQ ID NO: 5008 - DNA, 150 bp, Artificial Sequence
  Description of Artificial Sequence: Synthetic polynucleotide
  modified_base (127)..(127): a, c, t, g, unknown or other
  modified_base (134)..(134): a, c, t, g, unknown or other
aagaaacttagaagtttcaaaaccaacatggtaaaatctaaatayrcttttatttctgtaaattaaaattatgatttaagaatatttattccttgatatgtctctwttgtattctgtaatcaaaacnctagaanaaaaataaagtgtctc

SEQ ID NO: 5009 - DNA, 370 bp, Artificial Sequence
  Description of Artificial Sequence: Synthetic polynucleotide
  modified_base (24)..(24): a, c, t, g, unknown or other
  modified_base (30)..(30): a, c, t, g, unknown or other
  modified_base (103)..(103): a, c, t, g, unknown or other
  modified_base (135)..(135): a, c, t, g, unknown or other
  modified_base (175)..(175): a, c, t, g, unknown or other
  modified_base (199)..(199): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (351)..(351): a, c, t, g, unknown or other
taaaagagggaagatgacttttcntaaagngtggaataaagaaaagtaagatagcggatagaagcttgaagtgaaagcaggttcacaggaagtttctttggtntttgttttgtttttaaatagtggaaagrtgtntatgtttatggagaaagattgccttgaagatgcaagaggnagagatgatcaaaattcaagaagnagcagaaagtgatagaataaagagcacaagtggagaantantgttaatgaaaagaaggntgcttcctttgatatgaagtgaaggaagagagaatgagtaaagaccaagacttgaagtccctagtttaatagagggagatttcttcttttgantagcaacartggtattytg

SEQ ID NO: 5010 - DNA, 19 bp, Artificial Sequence
  Description of Artificial Sequence: Synthetic primer
gtactcaaatcaaattggc

SEQ ID NO: 5011 - DNA, 20 bp, Artificial Sequence
  Description of Artificial Sequence: Synthetic primer
gaaaaaagtgcatgtctttg

SEQ ID NO: 5012 - DNA, 20 bp, Artificial Sequence
  Description of Artificial Sequence: Synthetic primer
cccagatgaaggggttttag

SEQ ID NO: 5013 - DNA, 19 bp, Artificial Sequence
  Description of Artificial Sequence: Synthetic primer
aagaccaagattcagaagc

SEQ ID NO: 5014 - DNA, 20 bp, Artificial Sequence
  Description of Artificial Sequence: Synthetic primer
gtgaattcttcccacttctc

SEQ ID NO: 5015 - DNA, 20 bp, Artificial Sequence
  Description of Artificial Sequence: Synthetic primer
gagaattaaaatgaactgag

SEQ ID NO: 5016 - DNA, 20 bp, Artificial Sequence
  Description of Artificial Sequence: Synthetic primer
ggtaccactcatccataaac

SEQ ID NO: 5017 - DNA, 20 bp, Artificial Sequence
  Description of Artificial Sequence: Synthetic primer
accctcagtaccactatctc

SEQ ID NO: 5018 - DNA, 20 bp, Artificial Sequence
  Description of Artificial Sequence: Synthetic primer
caaggattccagtactggag

SEQ ID NO: 5019 - DNA, 20 bp, Artificial Sequence
  Description of Artificial Sequence: Synthetic primer
catatttgtctgtgtacttg

SEQ ID NO: 5020 - DNA, 20 bp, Artificial Sequence
  Description of Artificial Sequence: Synthetic primer
ggaatgttccacctttctac

SEQ ID NO: 5021 - DNA, 20 bp, Artificial Sequence
  Description of Artificial Sequence: Synthetic primer
cttcaaggcaatctttctcc

SEQ ID NO: 5022 - DNA, 20 bp, Artificial Sequence
  Description of Artificial Sequence: Synthetic primer
accagctacatctagattac

SEQ ID NO: 5023 - DNA, 20 bp, Artificial Sequence
  Description of Artificial Sequence: Synthetic primer
agctccgctttgatttcagg

SEQ ID NO: 5024 - DNA, 20 bp, Artificial Sequence
  Description of Artificial Sequence: Synthetic primer
ttcctgatgataatcttccc

SEQ ID NO: 5025 - DNA, 19 bp, Artificial Sequence
  Description of Artificial Sequence: Synthetic primer
aacggccagggtggacact

SEQ ID NO: 5026 - DNA, 20 bp, Artificial Sequence
  Description of Artificial Sequence: Synthetic primer
gatgcttctaaggaccatgt

SEQ ID NO: 5027 - DNA, 20 bp, Artificial Sequence
  Description of Artificial Sequence: Synthetic primer
ccatagcaagatgaattcac

SEQ ID NO: 5028 - DNA, 21 bp, Artificial Sequence
  Description of Artificial Sequence: Synthetic primer
caccagtatcagcaatagctt

SEQ ID NO: 5029 - DNA, 21 bp, Artificial Sequence
  Description of Artificial Sequence: Synthetic primer
gtgcctaaggacaactttttc

SEQ ID NO: 5030 - DNA, 20 bp, Artificial Sequence
  Description of Artificial Sequence: Synthetic primer
gaaccatggtttgggtttac

SEQ ID NO: 5031 - DNA, 20 bp, Artificial Sequence
  Description of Artificial Sequence: Synthetic primer
aataaagtccagagtatggc

SEQ ID NO: 5032 - DNA, 20 bp, Artificial Sequence
  Description of Artificial Sequence: Synthetic primer
attccaagggctatctccac

SEQ ID NO: 5033 - DNA, 20 bp, Artificial Sequence
  Description of Artificial Sequence: Synthetic primer
gctggatacctaattaatgc

SEQ ID NO: 5034 - DNA, 19 bp, Artificial Sequence
  Description of Artificial Sequence: Synthetic primer
aggtagttctctaagttac

SEQ ID NO: 5035 - DNA, 20 bp, Artificial Sequence
  Description of Artificial Sequence: Synthetic primer
acaaatattgacaggcagca

SEQ ID NO: 5036 - DNA, 21 bp, Artificial Sequence
  Description of Artificial Sequence: Synthetic primer
gaacagctatatttcaaaccc

SEQ ID NO: 5037 - DNA, 20 bp, Artificial Sequence
  Description of Artificial Sequence: Synthetic primer
cttcctgtgaacctgctttc

SEQ ID NO: 5038 - DNA, 20 bp, Artificial Sequence
  Description of Artificial Sequence: Synthetic primer
gaggccaatgcaaatgtagg

SEQ ID NO: 5039 - DNA, 20 bp, Artificial Sequence
  Description of Artificial Sequence: Synthetic primer
cttatcctttgggtcttctc

SEQ ID NO: 5040 - DNA, 20 bp, Artificial Sequence
  Description of Artificial Sequence: Synthetic primer
ttgtgtgtaggattatgagc

SEQ ID NO: 5041 - DNA, 20 bp, Artificial Sequence
  Description of Artificial Sequence: Synthetic primer
gaatgtagctgttgttaggg

SEQ ID NO: 5042 - DNA, 20 bp, Artificial Sequence
  Description of Artificial Sequence: Synthetic primer
tccctctctccctgaaaaag

SEQ ID NO: 5043 - DNA, 20 bp, Artificial Sequence
  Description of Artificial Sequence: Synthetic primer
gactaggttactgagcaagg

SEQ ID NO: 5044 - DNA, 19 bp, Artificial Sequence
  Description of Artificial Sequence: Synthetic primer
ttagattgttatccccact

SEQ ID NO: 5045 - DNA, 20 bp, Artificial Sequence
  Description of Artificial Sequence: Synthetic primer
aagaactccagggctacttg

SEQ ID NO: 5046 - DNA, 20 bp, Artificial Sequence
  Description of Artificial Sequence: Synthetic primer
tggttctcaacactgaccac

SEQ ID NO: 5047 - DNA, 20 bp, Artificial Sequence
  Description of Artificial Sequence: Synthetic primer
atgtaggcattgtaatgagg

SEQ ID NO: 5048 - DNA, 20 bp, Artificial Sequence
  Description of Artificial Sequence: Synthetic primer
gataacataagattaggaac

SEQ ID NO: 5049 - DNA, 20 bp, Artificial Sequence
  Description of Artificial Sequence: Synthetic primer
gattatgatgcactggcctg

SEQ ID NO: 5050 - DNA, 21 bp, Artificial Sequence
  Description of Artificial Sequence: Synthetic primer
ctgaagaagtgtaaaaatggc

SEQ ID NO: 5051 - DNA, 20 bp, Artificial Sequence
  Description of Artificial Sequence: Synthetic primer
ctgctaactcagatacctgc

SEQ ID NO: 5052 - DNA, 20 bp, Artificial Sequence
  Description of Artificial Sequence: Synthetic primer
gtctcacatcccatttacag

SEQ ID NO: 5053 - DNA, 19 bp, Artificial Sequence
  Description of Artificial Sequence: Synthetic primer
tcaattagaaatctagtgc

SEQ ID NO: 5054 - DNA, 20 bp, Artificial Sequence
  Description of Artificial Sequence: Synthetic primer
tatataatacttagttttgg

SEQ ID NO: 5055 - DNA, 20 bp, Artificial Sequence
  Description of Artificial Sequence: Synthetic primer
ttcctttatgggaggaggag

SEQ ID NO: 5056 - DNA, 20 bp, Artificial Sequence
  Description of Artificial Sequence: Synthetic primer
attggccaacatctcaacag

SEQ ID NO: 5057 - DNA, 20 bp, Artificial Sequence
  Description of Artificial Sequence: Synthetic primer
gtgtgcttgcctcctaattt

SEQ ID NO: 5058 - DNA, 20 bp, Artificial Sequence
  Description of Artificial Sequence: Synthetic primer
gaaagttcttgtattaaaag

SEQ ID NO: 5059 - DNA, 19 bp, Artificial Sequence
  Description of Artificial Sequence: Synthetic primer
tgttcttggttgactttac

SEQ ID NO: 5060 - DNA, 19 bp, Artificial Sequence
  Description of Artificial Sequence: Synthetic primer
cttttaccagttatcttcc

SEQ ID NO: 5061 - DNA, 20 bp, Artificial Sequence
  Description of Artificial Sequence: Synthetic primer
catgggcaaacataatttgg

SEQ ID NO: 5062 - DNA, 20 bp, Artificial Sequence
  Description of Artificial Sequence: Synthetic primer
ctgtgtcaatggcacatctg

SEQ ID NO: 5063 - DNA, 20 bp, Artificial Sequence
  Description of Artificial Sequence: Synthetic primer
atatttcaagtatcactatg

SEQ ID NO: 5064 - DNA, 20 bp, Artificial Sequence
  Description of Artificial Sequence: Synthetic primer
gcatcaggacaaactgatgg

SEQ ID NO: 5065 - DNA, 21 bp, Artificial Sequence
  Description of Artificial Sequence: Synthetic primer
gtgctataaagctttaacaag

SEQ ID NO: 5066 - DNA, 20 bp, Artificial Sequence
  Description of Artificial Sequence: Synthetic primer
gaggcaactaggacttaagg

SEQ ID NO: 5067 - DNA, 20 bp, Artificial Sequence
  Description of Artificial Sequence: Synthetic primer
agattatgatgcactggcct

SEQ ID NO: 5068 - DNA, 20 bp, Artificial Sequence
  Description of Artificial Sequence: Synthetic primer
ggaaagttagaaggccacac

SEQ ID NO: 5069 - DNA, 19 bp, Artificial Sequence
  Description of Artificial Sequence: Synthetic primer
ttgttgctccaagtttaag

SEQ ID NO: 5070 - DNA, 21 bp, Artificial Sequence
  Description of Artificial Sequence: Synthetic primer
gttttcccatatctagatgtc

SEQ ID NO: 5071 - DNA, 19 bp, Artificial Sequence
  Description of Artificial Sequence: Synthetic primer
tacttaatccttttgcctc

SEQ ID NO: 5072 - DNA, 20 bp, Artificial Sequence
  Description of Artificial Sequence: Synthetic primer
gggctgtttcaatgagggac

SEQ ID NO: 5073 - DNA, 19 bp, Artificial Sequence
  Description of Artificial Sequence: Synthetic primer
cttgtattaaaagaagtgg

SEQ ID NO: 5074 - DNA, 20 bp, Artificial Sequence
  Description of Artificial Sequence: Synthetic primer
ggagtcaagggagcatttta

SEQ ID NO: 5075 - DNA, 20 bp, Artificial Sequence
  Description of Artificial Sequence: Synthetic primer
gaggcaaacattatacacac

SEQ ID NO: 5076 - DNA, 19 bp, Artificial Sequence
  Description of Artificial Sequence: Synthetic primer
actgaagtcattcattagg

SEQ ID NO: 5077 - DNA, 20 bp, Artificial Sequence
  Description of Artificial Sequence: Synthetic primer
gcaggttcacaggaagtttc

SEQ ID NO: 5078 - DNA, 20 bp, Artificial Sequence
  Description of Artificial Sequence: Synthetic primer
ctgtgaggccaatgcaaatg

SEQ ID NO: 5079 - DNA, 20 bp, Artificial Sequence
  Description of Artificial Sequence: Synthetic primer
gtggctatgaaagacagcct

SEQ ID NO: 5080 - DNA, 20 bp, Artificial Sequence
  Description of Artificial Sequence: Synthetic primer
gggaagatcttaaagggagc

SEQ ID NO: 5081 - DNA, 20 bp, Artificial Sequence
  Description of Artificial Sequence: Synthetic primer
acaccacatttctaccactg

SEQ ID NO: 5082 - DNA, 20 bp, Artificial Sequence
  Description of Artificial Sequence: Synthetic primer
tgatacagaaatgtcaaccc

SEQ ID NO: 5083 - DNA, 20 bp, Artificial Sequence
  Description of Artificial Sequence: Synthetic primer
ctccccaaagtctcagatag

SEQ ID NO: 5084 - DNA, 21 bp, Artificial Sequence
  Description of Artificial Sequence: Synthetic primer
ggaacagtgttgataaagact

SEQ ID NO: 5085 - DNA, 19 bp, Artificial Sequence
  Description of Artificial Sequence: Synthetic primer
ccaaattttcaagcaaagc

SEQ ID NO: 5086 - DNA, 19 bp, Artificial Sequence
  Description of Artificial Sequence: Synthetic primer
gaagtggcctatcaggtct

SEQ ID NO: 5087 - DNA, 19 bp, Artificial Sequence
  Description of Artificial Sequence: Synthetic primer
ggactttggcacccaagga

SEQ ID NO: 5088 - DNA, 20 bp, Artificial Sequence
  Description of Artificial Sequence: Synthetic primer
ttcctacctcacttggcttc

SEQ ID NO: 5089 - DNA, 20 bp, Artificial Sequence
  Description of Artificial Sequence: Synthetic primer
gttacactgcaaagcatttc

SEQ ID NO: 5090 - DNA, 21 bp, Artificial Sequence
  Description of Artificial Sequence: Synthetic primer
ggcaaacataatttggatggg

SEQ ID NO: 5091 - DNA, 20 bp, Artificial Sequence
  Description of Artificial Sequence: Synthetic primer
ctgtgtcaaatatgtgactg

SEQ ID NO: 5092 - DNA, 19 bp, Artificial Sequence
  Description of Artificial Sequence: Synthetic primer
tttcagaccatttttgaac

SEQ ID NO: 5093 - DNA, 20 bp, Artificial Sequence
  Description of Artificial Sequence: Synthetic primer
aagagggaagatgacttttc

SEQ ID NO: 5094 - DNA, 19 bp, Artificial Sequence
  Description of Artificial Sequence: Synthetic primer
cagagggtagaagggaggc

SEQ ID NO: 5095 - DNA, 21 bp, Artificial Sequence
  Description of Artificial Sequence: Synthetic primer
gagttctagtttggcaaactt

SEQ ID NO: 5096 - DNA, 20 bp, Artificial Sequence
  Description of Artificial Sequence: Synthetic primer
atgctgatgaaccgcacttc

SEQ ID NO: 5097 - DNA, 20 bp, Artificial Sequence
  Description of Artificial Sequence: Synthetic primer
ctgggcaactgtgaaaagac

SEQ ID NO: 5098 - DNA, 19 bp, Artificial Sequence
  Description of Artificial Sequence: Synthetic primer
gaccaaagtgtatacatag

SEQ ID NO: 5099 - DNA, 20 bp, Artificial Sequence
  Description of Artificial Sequence: Synthetic primer
ccttttaaaatatgcacgag

SEQ ID NO: 5100 - DNA, 20 bp, Artificial Sequence
  Description of Artificial Sequence: Synthetic primer
taaatgagcagagactcaag

SEQ ID NO: 5101 - DNA, 20 bp, Artificial Sequence
  Description of Artificial Sequence: Synthetic primer
aaagctttaacaagttggcg

SEQ ID NO: 5102 - DNA, 19 bp, Artificial Sequence
  Description of Artificial Sequence: Synthetic primer
gttgtgactattgttatag

SEQ ID NO: 5103 - DNA, 20 bp, Artificial Sequence
  Description of Artificial Sequence: Synthetic primer
gacttgaatttaactgctcc

SEQ ID NO: 5104 - DNA, 19 bp, Artificial Sequence
  Description of Artificial Sequence: Synthetic primer
aacttgccttcaagatctg

SEQ ID NO: 5105 - DNA, 20 bp, Artificial Sequence
  Description of Artificial Sequence: Synthetic primer
gaaaaaagtgcatgtctttg

SEQ ID NO: 5106 - DNA, 20 bp, Artificial Sequence
  Description of Artificial Sequence: Synthetic primer
gtctaccaaactacaattag

SEQ ID NO: 5107 - DNA, 20 bp, Artificial Sequence
  Description of Artificial Sequence: Synthetic primer
ctttccaaaaacccacaatc

SEQ ID NO: 5108 - DNA, 19 bp, Artificial Sequence
  Description of Artificial Sequence: Synthetic primer
agggctgcagggacagtag

SEQ ID NO: 5109 - DNA, 20 bp, Artificial Sequence
  Description of Artificial Sequence: Synthetic primer
tatttttatttccaatgtag

SEQ ID NO: 5110 - DNA, 20 bp, Artificial Sequence
  Description of Artificial Sequence: Synthetic primer
tcatccccatttctcaactc

SEQ ID NO: 5111 - DNA, 20 bp, Artificial Sequence
  Description of Artificial Sequence: Synthetic primer
gctgatcaaggcagtttttc

SEQ ID NO: 5112 - DNA, 20 bp, Artificial Sequence
  Description of Artificial Sequence: Synthetic primer
tttagcattcccagactcag

SEQ ID NO: 5113 - DNA, 20 bp, Artificial Sequence
  Description of Artificial Sequence: Synthetic primer
actgttatgtacattatatc

SEQ ID NO: 5114 - DNA, 20 bp, Artificial Sequence
  Description of Artificial Sequence: Synthetic primer
accctcagtaccactatctc

SEQ ID NO: 5115 - DNA, 20 bp, Artificial Sequence
  Description of Artificial Sequence: Synthetic primer
tgtgtgcaaggctctagaag

SEQ ID NO: 5116 - DNA, 20 bp, Artificial Sequence
  Description of Artificial Sequence: Synthetic primer
ccaaggttgcttataaacag

SEQ ID NO: 5117 - DNA, 21 bp, Artificial Sequence
  Description of Artificial Sequence: Synthetic primer
gttctctaagttaccaaaatc

SEQ ID NO: 5118 - DNA, 19 bp, Artificial Sequence
  Description of Artificial Sequence: Synthetic primer
gtatatataactcctgatc

SEQ ID NO: 5119 - DNA, 20 bp, Artificial Sequence
  Description of Artificial Sequence: Synthetic primer
cagcatagctttaatggtcc

SEQ ID NO: 5120 - DNA, 20 bp, Artificial Sequence
  Description of Artificial Sequence: Synthetic primer
tctgtgacacagagcatgag

SEQ ID NO: 5121 - DNA, 20 bp, Artificial Sequence
  Description of Artificial Sequence: Synthetic primer
aactccagggctacttgaac

SEQ ID NO: 5122 - DNA, 18 bp, Artificial Sequence
  Description of Artificial Sequence: Synthetic primer
tcaaattggcttacttgc

SEQ ID NO: 5123 - DNA, 19 bp, Artificial Sequence
  Description of Artificial Sequence: Synthetic primer
tgatgaatgcagtgaagtc

SEQ ID NO: 5124 - DNA, 26 bp, Artificial Sequence
  Description of Artificial Sequence: Synthetic primer
gttttagtattgaatttagtgcttag

SEQ ID NO: 5125 - DNA, 17 bp, Artificial Sequence
  Description of Artificial Sequence: Synthetic primer
gcagggctatgcgggag

SEQ ID NO: 5126 - DNA, 20 bp, Artificial Sequence
  Description of Artificial Sequence: Synthetic primer
cacttctcacttatcatctg

SEQ ID NO: 5127 - DNA, 24 bp, Artificial Sequence
  Description of Artificial Sequence: Synthetic primer
gaattaaaatgaactgaggatttc

SEQ ID NO: 5128 - DNA, 18 bp, Artificial Sequence
  Description of Artificial Sequence: Synthetic primer
tccataaacaccaacact

SEQ ID NO: 5129 - DNA, 24 bp, Artificial Sequence
  Description of Artificial Sequence: Synthetic primer
cctcagtaccactatctcaatctt

SEQ ID NO: 5130 - DNA, 19 bp, Artificial Sequence
  Description of Artificial Sequence: Synthetic primer
ccagtactggagaatgtct

SEQ ID NO: 5131 - DNA, 21 bp, Artificial Sequence
  Description of Artificial Sequence: Synthetic primer
ttgtctgtgtacttgtgctct

SEQ ID NO: 5132 - DNA, 26 bp, Artificial Sequence
  Description of Artificial Sequence: Synthetic primer
aatgttccacctttctaccttttttt

SEQ ID NO: 5133 - DNA, 22 bp, Artificial Sequence
  Description of Artificial Sequence: Synthetic primer
gcaatctttctccataaacata

SEQ ID NO: 5134 - DNA, 25 bp, Artificial Sequence
  Description of Artificial Sequence: Synthetic primer
gctacatctagattacaagccttat

SEQ ID NO: 5135 - DNA, 23 bp, Artificial Sequence
  Description of Artificial Sequence: Synthetic primer
ttgatttcaggcttcatagtttg

SEQ ID NO: 5136 - DNA, 27 bp, Artificial Sequence
  Description of Artificial Sequence: Synthetic primer
tatagccaataaattactcttatttta

SEQ ID NO: 5137 - DNA, 21 bp, Artificial Sequence
  Description of Artificial Sequence: Synthetic primer
gccagggtggacactgttact

SEQ ID NO: 5138 - DNA, 23 bp, Artificial Sequence
  Description of Artificial Sequence: Synthetic primer
ggaccatgtaatttctttaattc

SEQ ID NO: 5139 - DNA, 25 bp, Artificial Sequence
  Description of Artificial Sequence: Synthetic primer
caagatgaattcacttaacgaagtt

SEQ ID NO: 5140 - DNA, 19 bp, Artificial Sequence
  Description of Artificial Sequence: Synthetic primer
tcagcaatagctttgactt

SEQ ID NO: 5141 - DNA, 23 bp, Artificial Sequence
  Description of Artificial Sequence: Synthetic primer
ggacaactttttctttttcttct

SEQ ID NO: 5142 - DNA, 22 bp, Artificial Sequence
  Description of Artificial Sequence: Synthetic primer
ctgttctattacagtgttcttc

SEQ ID NO: 5143 - DNA, 18 bp, Artificial Sequence
  Description of Artificial Sequence: Synthetic primer
agagtatggctgggaatt

SEQ ID NO: 5144 - DNA, 17 bp, Artificial Sequence
  Description of Artificial Sequence: Synthetic primer
ccggctctgaacgcctc

SEQ ID NO: 5145 - DNA, 20 bp, Artificial Sequence
  Description of Artificial Sequence: Synthetic primer
gaaccaaacaaggaaaatac

SEQ ID NO: 5146 - DNA, 26 bp, Artificial Sequence
  Description of Artificial Sequence: Synthetic primer
aggtagttctctaagttaccaaaatc

SEQ ID NO: 5147 - DNA, 17 bp, Artificial Sequence
  Description of Artificial Sequence: Synthetic primer
gacaggcagcagattat

SEQ ID NO: 5148 - DNA, 26 bp, Artificial Sequence
  Description of Artificial Sequence: Synthetic primer
aacagctatatttcaaacccttttta

SEQ ID NO: 5149 - DNA, 25 bp, Artificial Sequence
  Description of Artificial Sequence: Synthetic primer
gctatcttacttttctttattccac

SEQ ID NO: 5150 - DNA, 24 bp, Artificial Sequence
  Description of Artificial Sequence: Synthetic primer
gtaatctagatgtagctggtatca

SEQ ID NO: 5151 - DNA, 24 bp, Artificial Sequence
  Description of Artificial Sequence: Synthetic primer
ttaacctctgtttcaaaatactgg

SEQ ID NO: 5152 - DNA, 26 bp, Artificial Sequence
  Description of Artificial Sequence: Synthetic primer
tgtgtgtaggattatgagcatccatt

SEQ ID NO: 5153 - DNA, 25 bp, Artificial Sequence
  Description of Artificial Sequence: Synthetic primer
tgtagctgttgttagggataggaga

SEQ ID NO: 5154 - DNA, 22 bp, Artificial Sequence
  Description of Artificial Sequence: Synthetic primer
aaaagagacacatttgcctttg

SEQ ID NO: 5155 - DNA, 21 bp, Artificial Sequence
  Description of Artificial Sequence: Synthetic primer
gttactgagcaaggaaaataa

SEQ ID NO: 5156 - DNA, 20 bp, Artificial Sequence
  Description of Artificial Sequence: Synthetic primer
tgttatccccacttctttaa

SEQ ID NO: 5157 - DNA, 18 bp, Artificial Sequence
  Description of Artificial Sequence: Synthetic primer
agggctacttgaacaatt

SEQ ID NO: 5158 - DNA, 24 bp, Artificial Sequence
  Description of Artificial Sequence: Synthetic primer
ccactagtattaacatacagttta

SEQ ID NO: 5159 - DNA, 20 bp, Artificial Sequence
  Description of Artificial Sequence: Synthetic primer
aatgaggtttttggtctttg

SEQ ID NO: 5160 - DNA, 23 bp, Artificial Sequence
  Description of Artificial Sequence: Synthetic primer
acataagattaggaacaagaata

SEQ ID NO: 5161 - DNA, 21 bp, Artificial Sequence
  Description of Artificial Sequence: Synthetic primer
gacttcactgcattcatcagc

SEQ ID NO: 5162 - DNA, 18 bp, Artificial Sequence
  Description of Artificial Sequence: Synthetic primer
ggcaacatgcatatagag

SEQ ID NO: 5163 - DNA, 17 bp, Artificial Sequence
  Description of Artificial Sequence: Synthetic primer
cagatacctgcatgtca

SEQ ID NO: 5164 - DNA, 27 bp, Artificial Sequence
  Description of Artificial Sequence: Synthetic primer
cccatttacagtttatgtgtcagctac

SEQ ID NO: 5165 - DNA, 26 bp, Artificial Sequence
  Description of Artificial Sequence: Synthetic primer
caattagaaatctagtgcaaaagaat

SEQ ID NO: 5166 - DNA, 21 bp, Artificial Sequence
  Description of Artificial Sequence: Synthetic primer
atacttagttttggtcatcaa

SEQ ID NO: 5167 - DNA, 23 bp, Artificial Sequence
  Description of Artificial Sequence: Synthetic primer
tttctttctatgtctttggttat

SEQ ID NO: 5168 - DNA, 19 bp, Artificial Sequence
  Description of Artificial Sequence: Synthetic primer
acatctcaacagagttaca

SEQ ID NO: 5169 - DNA, 25 bp, Artificial Sequence
  Description of Artificial Sequence: Synthetic primer
cctcctaatttaaaatactgtattc

SEQ ID NO: 5170 - DNA, 24 bp, Artificial Sequence
  Description of Artificial Sequence: Synthetic primer
aagttcttgtattaaaagaagtgg

SEQ ID NO: 5171 - DNA, 24 bp, Artificial Sequence
  Description of Artificial Sequence: Synthetic primer
aacagagaaaattaaaatcaaaca

SEQ ID NO: 5172 - DNA, 20 bp, Artificial Sequence
  Description of Artificial Sequence: Synthetic primer
cttcattgctttcacttttc

SEQ ID NO: 5173 - DNA, 22 bp, Artificial Sequence
  Description of Artificial Sequence: Synthetic primer
caaacataatttggatgggtct

SEQ ID NO: 5174 - DNA, 26 bp, Artificial Sequence
  Description of Artificial Sequence: Synthetic primer
tgtgtcaatggcacatctgaattact

SEQ ID NO: 5175 - DNA, 25 bp, Artificial Sequence
  Description of Artificial Sequence: Synthetic primer
atttcaagtatcactatgtacaatc

SEQ ID NO: 5176 - DNA, 17 bp, Artificial Sequence
  Description of Artificial Sequence: Synthetic primer
cagcctaggttttcctc

SEQ ID NO: 5177 - DNA, 23 bp, Artificial Sequence
  Description of Artificial Sequence: Synthetic primer
ataaagctttaacaagttggcga

SEQ ID NO: 5178 - DNA, 68 bp, Artificial Sequence
  Description of Artificial Sequence: Synthetic oligonucleotide
acccacacagtgggcttggtgacatcctaggatttgatttattccacccctagaatccaacctttcct

SEQ ID NO: 5179 - DNA, 68 bp, Artificial Sequence
  Description of Artificial Sequence: Synthetic oligonucleotide
tgggtgtgtcacccgaaccactgtaggatcctaaactagataaggtggggatcttaggttggaaagga
